(12) United States Patent
Shen et al.

(10) Patent No.: US 7,153,667 B2
(45) Date of Patent: Dec. 26, 2006

(54) DISCRETE ACYLTRANSFERASES ASSOCIATED WITH TYPE I POLYKETIDE SYNTHASES AND METHODS OF USE

(75) Inventors: Ben Shen, Verona, WI (US); Yi-Qiang Cheng, Madison, WI (US); Gong-Li Tang, Madison, WI (US)

(73) Assignee: Wisconsin Alumni Research Foundation (WARF), Madison, WI (US)

( * ) Notice: Subject to any disclaimer, the term of this patent is extended or adjusted under 35 U.S.C. 154(b) by 388 days.

(21) Appl. No.: 10/314,657

(22) Filed: Dec. 9, 2002

(65) Prior Publication Data

US 2003/0175888 A1 Sep. 18, 2003

Related U.S. Application Data

(63) Continuation-in-part of application No. PCT/US02/08937, filed on Mar. 22, 2002.

(60) Provisional application No. 60/278,935, filed on Mar. 26, 2001.

(51) Int. Cl.
C12P 21/06 (2006.01)
C12N 9/10 (2006.01)

(52) U.S. Cl. ............ 435/68.1; 435/69.1; 435/193

(58) Field of Classification Search ............ None
See application file for complete search history.

(56) References Cited

U.S. PATENT DOCUMENTS 5,712,146 A * 1/1998 Khosla et al. ......... 435/252.35

OTHER PUBLICATIONS

Crosby et al. "Polyketide synthase acyl carrier proteins from Streptomyces: expression . . . " Biochimica et Biophysica Acta 1995, 1251, 32-42.*
Albertini, et al., Microbiology (1995) 141, 299-309.
Bierman, et al., Gene (1992) 116; 43.
Cane, et al., Science (1998) 282, 63-68.
Cane, et al., Chemistry & Biology (1999) 6.R319-R325.
Cheng, Y.-Q., Tang, G.-L., & Shen, B. J. Bacteriol. (2002) 1984, 7013-7024.
Duitman, E. H., et al., Proc. Natl. Acad. Sci. USA (1999) 96, 13294-13299.
Gates, K. S., Chem. Res. Toxicol. (2000) 13, 953-956.
Haydock, et al., FEBS Lett. (1995) 374, 246-248.
Higgins, D. G., et al., Methods Enzymol., (1996) 266, 383-402.
Huang, et al., Microbiology (2001) 147, 631-642.
Ikeda, et al., Proc. Natl. Acad. Sci. USA, 96, 9509-9514.
Kakavas, et al., J. Bacteriol. 179, (1997) 7515-7522.
Kuhtoss, et al., Gene (1996) 183, 231-236.
Liu, et al., J. Am. Chem. Soc. (1997) 119, 10553-10554.
McDaniel, et al., Proc. Natl. Acad. Sci. USA (1999) 96, 1846-1851.
Oliynyk, et al., Chem. Biol. (1996) 3, 833-839.
Paitan, et al., J. Mol. Bio. (1999) 286, 465-474.
Piel, J., Proc. Natl. Acad. Sci. USA (2002) 99, 14002-14007.
Reeves, et al., Biochemistry (2001), 40, 15464-15470.
Ruan, et al., J. Bacteriol. (1997) 179, 6416-6425.
Sanchez, et al., Chem. Biol. 92001) 8:725.
Schwecke, et al., Proc. Natl. Acad. Sci. USA (1995) 92, 7839-7843.
Serre, et al., J. Biol. Chem. (1995) 270, 12961-12964.
Stassi, et al., Proc. Natl. Acad. Sci. USA (1998) 95,7305-7309.
Wakil, S. J., Biochemistry (1989) 28:4523.
Walsh, et al., Curr. Opin. Chem. Biol. (1997) 1:309.
Wu, et al., Gene (2000) 251, 81-90.
Xue, et al., Proc. Natl. Acad. Sci. USA (1999) 96, 11740-11745.
Zhu, et al., Gene (2002) 298: 79-89.

* cited by examiner

*Primary Examiner*—Nashaat T. Nashed
(74) *Attorney, Agent, or Firm*—Godfrey & Kahn, S.C.

(57) ABSTRACT

Genetic and biochemical characterization of the leinamycin biosynthesis gene cluster from *Streptomyces atroolivaceus* S-140 revealed two PKS genes, lnmI and lnmJ, that encode six PKS modules, none of which contains a cognate AT domain. The AT activity is provided in trans by a discrete protein, LnmG, which loads the malonyl coenzyme A extender unit onto the ACP domains of all six PKS modules. This finding provides a basis for methods of engineering modular polyketide synthases and polyketide synthase/non-ribosomal peptide synthetases.

7 Claims, 17 Drawing Sheets

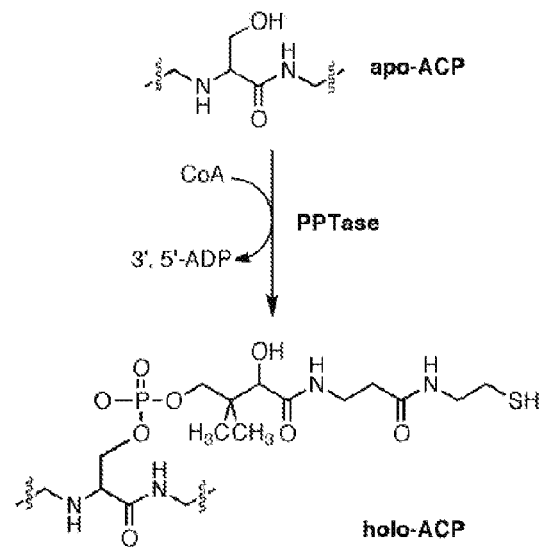

```
SC5A7      DGYGAAAIVRLTDLASLGIDAEPDGPLPDGVLESIALPAEVALLR-RLGGARPGVHWDRL
color      DGYGAAAIVRLTDLASLGIDAEPDGPLPDGVLESIALPAEVALLR-RLGGARPGVHWDRL
albus      KGYHAAAVARQDDVAAVGIDAEPHAPLPDGVLETIARPEDLTALS-ALP-ASGGIAWDRV
gris       NGYRAAALARATDVLSLGIDAEPHAPLPSGVRELVTLPAERERIGPPAPEGTGEIHWDRV
Svp        QGFRGAAVARAADAASLGIDAEPNGPLPDGVLAMVSLPSEREWLA-GLAARRPDVHWDRL
lnm        DGYRAAAVAGKGIVASTGIDAEPNARLPAGVLDLVTLADERDCVK-QLLDDNPEACWDRL
Consensus  .*: .**:.     ;;******.. ** **  ::  . :   :         ***:

SC5A7      LFSAKESVYKAWYPLT
color      LFSAKESVYKAWYPLT
albus      LFSAKEAVYKAWYPLT
gris       LFSAKESVYKAWYPLT
Svp        LFSAKESVFKAWYPLT
lnm        LLSAKESVFKAWYPLT
Consensus  *:****:*:*******
```

Fig. 5

DISCRETE ACYLTRANSFERASES ASSOCIATED WITH TYPE I POLYKETIDE SYNTHASES AND METHODS OF USE

CROSS-REFERENCE TO RELATED APPLICATIONS

This is a continuation-in-part application of International Application PCT/US02/08937, filed on Mar. 22, 2002 which claimed the benefit of and priority to U.S. Provisional Application 60/278,935, filed on Mar. 26, 2001, both of which are incorporated herein by reference in their entirety for all purposes.

STATEMENT AS TO RIGHTS TO INVENTIONS MADE UNDER FEDERALLY SPONSORED RESEARCH AND DEVELOPMENT

This work was supported in part by grants from the National Institutes of Health (NIH)-AI51689 and CA 78747 and the National Science Foundation (NSF)-MCB 0196528. The Government of the United States of America may have certain rights in this invention.

FIELD OF INVENTION

This invention relates to the field of polyketide synthesis. In particular, this invention pertains to type I polyketide synthases requiring discrete acyltransferases and methods of using the discrete acyltransferases for the production of novel products.

BACKGROUND OF THE INVENTION

Polyketides and nonribosomal peptides are two large families of natural products that include many clinically valuable drugs, such as erthromycin and vancomycin (antibacterial), FK506 and cyclosporin (immunosuppressant), and epothilone, and bleomycin, or leinamycin (antitumor). The biosyntheses of polyketides and nonribosomal peptides are catalyzed by polyketide synthases (PKSs) (Hopwood (1997) *Chem. Rev.*, 97: 2465; Katz (1997) *Chem. Rev.*, 97: 22557; C Khosla, (1997) *Chem. Rev.*, 97: 22577; Ikeda and Omura, (1997) *Chem. Rev.*, 97: 2591; Staunton and Wilkinson (1997) *Chem. Rev.*, 97: 2611; Cane et al. (1998) *Science* 282: 63) and nonribosomal peptide synthetases (NRPSs) Cane et al. (1998) *Science* 282: 63). Marahiel et al. (1997) *Chem. Rev.*, 97: 2651; von Döhren et al. (1997) *Chem. Rev.*, 97: 2675), respectively. Remarkably, PKSs and NRPSs use a very similar strategy for the assembly of these two distinct classes of natural products by sequential condensation of short carboxylic amino acids, respectively, and utilize the same 4'-phosphopantetheine prosthetic group, via a thioster linkage, to channel the growing polyketide or peptide intermediate during the elongation processes.

Both type I PKSs and NRPSs are multifunctional proteins that are organized into modules. A module is defined as a set of distinctive domains that encode all the enzyme activities necessary for one cycle of polyketide or peptide chain elongation and associated modifications. The number and order of modules and the type of domains within a module on each PKS or NRPS protein determine the structural variations of the resulting polyketide and peptide products by dictating the number, order, choice of the carboxylic acid or amino acid to be incorporated, and the modifications associated with a particular cycle of elongation. Since the modular architecture of both PKS (Cane et al. (1998) *Science*, 282: 63; Katz and Danadio (1993) *Ann. Rev. Microbiol.* 47:875 (1993); Hutchinson and Fuji (1995) *Ann. Rev. Microbiol.* 49: 201) and NRPS (Cane et al. (1998) *Science* 282: 63, Stachelhaus et al. (1995) *Science* 269: 69, Stachelhaus et al. (1998) *Mol. Gen. Genet.* 257: 308; Belshaw et al. (1999) *Science* 284: 486) has been exploited successfully in combinatorial biosynthesis of diverse "unnatural" natural products, a hybrid PKS and NRPS system, capable of incorporating both caroboxylic acids and amino acids into the final products, can lead to even greater chemical structural diversity.

Leinamycin (Lnm) is a novel antitumor antibiotic produced by several *Streptomyces* species (Hara et al. (1989) *J. Antiobiot.* 42: 333–335; Hara et al. (1989) *J. Antiobiot.* 42: 1768–1774; Nakano et al. (1992) Pages 72–75 In *Harnessing Biotechnol.* 21$^{st}$ Center, Proc. Int. Biotechnol. Symp. Expo. 9$^{th}$, Ladisch, M. R. and Bose, A., eds., ACS: Washington, D.C.). Its structure was revealed by X-ray crystallographical (Hirayama and Matsuzawa (1993) *Chem. Lett.* (1957–1958) and spectroscopic analyses (Hara et al. (1989) *J. Antiobiot.* 42: 333–335; Hara et al (1989) *J. Antiobiot.* 42: 1768–1774; and confirmed by total synthesis (Kandra and Fukuyama (1993) *J. Am. Chem. Soc.* 115:8451–8452; Fukuyama and Kanda (1994) *J. Synth. Org. Chem. Japan,* 52: 888–899). It contains an unusual 1,3-dioxo-1,2-dithiolane moiety that is spiro-fused to thiazole-containing 18-membered lactam ring, a molecular architecture that has not been found to date in any other natural product (FIG. 1).

Lnm exhibits a broad spectrum of antimicrobial activity against Gram-positive and Gram-negative bacteria, but not against fungi. Lnm shows potent antitumor activity in murine tumor models in vivo, including HELA S3, sarcoma 180, B-16, Colon 26, and leukemia P388. It is also active against murine models inoculated with tumors that are resistant to clinically important antitumor drugs, such as cisplatin, doxorubicin, mitomycin, or cyclophosphamide (Hara et al. (1989) *J. Antibiot.* 42: 333–335; Hara et al. (1989) *J. Antiobiot.* 42: 1768–1774; Nakano et al. In *Harnessing Biotechnol.* 21$^{st}$ Century, Proc. Int. Biotechnol. Symp. Expo. 9$^{th}$, Ladish, M. R. and Bose, A., eds., ACS: Washington, D.C.). Lnm preferentially inhibits DNA synthesis and interacts directly with DNA to cause single-strand scission of DNA in the presence of thiol agents as cofactors. The presence of the sulfoxide group in the dithiolane moeity is essential for the DNA-cleaving activity Hara et al. (1990) *Biochemistry* 29: 5676–5681). Interestingly, simple 1,3-dioxo-1,2-dithioilanes are also thiol-dependent DNA cleaving agents in vitro (Behroozi et al. (1995) *J. Org. Chem.* 60: 3964–3966; Behroozi et al. (1996) *Biochemistry* 35: 1768–1774; Mitra et al. (1997) *J. Am. Chem. Soc.* 119: 11691–11692). However, the mechanisms for DNA cleavage by simple 1,3-dioxo-1,2-dithiolanes and Lnm are distinct oxidative cleavage by 1,3-dioxo-1,2-dithiolanes that convert molecular oxygen to DNA-cleaving oxygen radicals mediated by polysulfides (Behroozi et al. (1995) *J. Org. Chem.* 60: 3964–3966; Behroozi et al. (1996) *Biochemistry* 35: 1768–1774; Mitra et al. (1997) *J. Am. Chem. Soc.* 119: 11691–11692) and alkylative cleavage by Lnm mediated by an episulfonium ion intermediate (Mitra et al. (1997) *J. Chem. Soc.* 119: 11691–11692; Asai et al. (1996) *J. Am. Chem. Soc.* 118:6802–6803; Asai et al. (1997) *Bioorg. Med. Chem.* 5: 723–729) (FIG. 1). The latter mechanism represents an unprecedented mode of action for the thiol-dependent DNA cleavage by Lnm.

Aimed at discovering clinically useful Lnm analogs, both total synthesis (Kandra and Fukuyama (1993) *J. Chem. Soc.* 115: 8451–8452; Fukuyama and Kandra (1994) *J. Synth.*

Org. Chem. Japan, 52: 888–899; Pattenden and Shuker (1991) Tetrahedron Lett. 32:6625–6628; Pattenden and Shuker (1992) J. Chem. Soc. Perkin Trans I, 1215–1221; Kandra et al. (1992) Tetrahedron Lett. 33: 5701–5704; Pattenden and Thom (1993) Synlett 215–216) and chemical modification of the natural Lnm have been investigated. Modifications at both C-8 hydroxy and C-9 keto groups as well as the 1,3-dioxo-1,2-dithiolane moiety have generated a number of Lnm analogs with improved antitumor activity and in vivo stability (Kandra et al. (1998) Bioorg. Med. Chem. Lett. 8: 909–912; Kandra et al. (1999) J. Med. Chem. 42: 1330–1332), supporting the wisdom of making novel anticancer drugs based on the Lnm scaffold. However, for a complex molecule like Lnm, chemical total synthesis has very limited practical value, and chemical modification only can access to limited functional groups, often requiring multiple extra protection/deprotection steps.

SUMMARY OF THE INVENTION

This invention pertains to the isolation and elucidation of the leinamycin gene cluster (see SEQ ID NO:1). This gene cluster (nucleic acid sequence) encodes all of the open reading frames (ORFs) that encode polypeptides sufficient to direct the biosynthesis of leinamycin. The nucleic acids can be used in their "native" format or recombined in a wide variety of manners to create novel synthetic pathways.

Thus, in one embodiment, this invention provides an isolated nucleic acid comprising a nucleic acid selected from the group consisting of: 1) A nucleic acid encoding one or more leinamycin (lnm) open reading frames (ORFs) identified in Tables 1 and 2 (ORFs –35 through –1 (SEQ ID NO 2–36), lnmA through lnmZ' (SEQ ID NO 37–63), and +1 through +9 (SEQ ID NO 64–72)). A nucleic acid encoding a polypeptide encoded by any one or more of leinamycin (lnm) open reading frames (ORFs) identified in Tables 1 and 2 (ORFs –35 through –1 (SEQ ID NO 2–36), lnmA through lnmZ' (SEQ ID NO 37–63), and +1 through +9 (SEQ ID NO 64–72)); 3) A nucleic acid comprising the nucleotide sequence of a nucleic acid amplified by polymerase chain reaction (PCR) using any one of the primer pairs identified in Table 2 and the nucleic acid of a leinamycin-producing organism as a template; and 4) A nucleic acid that encodes a protein comprising at least one catalytic domain selected from the group consisting of a condensation (c) domain, an adenylation (A) domain, a peptidyl carrier protein (PCP) domain, a condensation/cyclization (cy), an acyl-carrier protein (ACP)-like domain, an oxidization domain (Ox), and enoyl reductase domain (ER), a methyltransferase domain, a phosphotransferase domain, a peptide synthase domain, and an aminotransferase domain, and that specifically hybridizes to on or more of lnm ORFs –35 through –1 (SEQ ID NO 2–36), lnmA through lnmZ' (SEQ ID NO 37–63) and/or +1 through +9 (SEQ ID NO 64–72) under stringent conditions.

In certain embodiments, the isolated nucleic acid comprises a nucleic acid encoding at least two, preferably at least three, more preferably at least four, and most preferably at least five, open reading frames independently selected from the group consisting of leinamycin (lnm) open reading frames –35 through –1 (SEQ ID NO 2–36), lnmA through lnmZ' (SEQ ID NO 37–63) and +1 through +9 (SEQ ID NO 64–72). In particularly preferred embodiments, the isolated nucleic acid encodes a module. In another embodiment, the nucleic acid comprises a nucleic acid encoding a module comprising two or more catalytic domains of a protein encoded by a nucleic acid of a leinamycin (lnm) gene cluster where the catalytic domains are selected from group consisting of a condensation (C) domain, an adenylation (A) domain, a peptidyl-carrier protein (PCP) domain, a condensation/cyclization domain (Cy), an acyl-carrier protein (ACP)-like domain, an oxidation domain (Ox), an enoyl reductase domain, a methyltransferase domain, a phosophotransferase domain, a peptide synthetase domain, and an aminotransferase domain. In particularly preferred embodiments, the nucleic acid comprises an open reading frame from the Streptomyces atroolivaceus leinamycin biosynthetic gene cluster SEQ ID NO: 1 or the complement thereof (e.g. as described in Table 2). In other preferred embodiments, the nucleic acid has the nucleotide sequence of a nucleic acid amplified by polymerase chain reaction (PCR) using any one of the primer pairs identified in Table 2 and the nucleic acid of a leinamyicin-producing organism (e.g. S. atroolivaceus) as a template.

In still yet another embodiment, this intervention provides an isolated nucleic acid comprising a leinamycin (lnm) open reading frame (ORF) or an allelic variant thereof (e.g. a single nucleotide polymorphism (SNP) of a leinamycin (lnm) open reading frame (ORF)).

In another embodiment, this invention provides an isolated gene cluster comprising open reading frames encoding polypeptides sufficient to direct the assembly of a leinamycin.

In one embodiment, this invention provides an isolated nucleic acid encoding a multi-functional protein complex comprising both a polyketide synthase (PKS) and a peptide synthetase (NRPS), where the polyketide synthase or the peptide synthetase, has the amino acid sequence of a PKS or an NRPS encoded by the leinamycin (lnm) gene cluster.

This invention also provides for various proteins. Thus, in one embodiment, this invention provides an isolated multifunctional protein complex comprising both a polyketide synthase (PKS) and a peptide synthetase (NRPS), where the polyketide synthase (PKS) and/or the peptide synthetase (NRPS) has the amino acid sequence of a PKS or an NRPS found encoded by a nucleic acid from the leinamycin gene cluster (SEQ ID NO 1).

In another embodiment, this invention provides a polypeptide selected from the group consisting of: 1) A catalytic domain encoded by one or more leinamycin (lnm) open reading frames (ORFs) e.g. ORFs –35 through –1 (SEQ ID NO 2–36), lnmA through lnmZ' (SEQ ID NO 37–63), and +1 through +9 (SEQ ID NO 64–72), (e.g. as identified in Table 2); 2) A catalytic domain encoded by a nucleic acid having the sequence of a nucleic acid amplified by polymerase chain reaction (PCR) using any one of the primer pairs identified Table 2; and 3) A module comprising two or more catalytic domains of a protein encoded by a nucleic acid of a leinamycin gene cluster. In preferred embodiments, the polypeptide comprises an enzymatic domain selected from the group consisting of a condensation (C) domain, an adenylation (A) domain, a peptidyl carrier protein (PCP) domain, a condensation/cyclization domain (Cy), an acyl-carrier protein (ACP)-like domain, an oxidization domain (Ox), an NADH dehydrogenase domain, a methyltransferase domain, a phosphotransferase domain, peptide synthetase domain, and an aminotransferase domain. In certain embodiments, the polypeptide comprises domains encoded by at least two, preferably at least three, more preferably at least four, and most preferably at least five, open reading frames independently selected from the group consisting of leinamycin (lnm) open reading frames SEQ ID NOs 1 through 72. In certain embodiments, the polypeptide can comprise a module comprising two or more catalytic domains of a protein encoded by a nucleic acid of a leinamycin gene cluster where the catalytic domains are selected from the group consisting of a condensation (C) domain, an adenylation(A) domain, a peptidyl carrier protein (PCP) domain, a condensation/cyclization domain (Cy), an acyl-carrier protein (ACP)-like domain, an oxidization domain (Ox), an enoyl reductase domain (ER), a methyltransferase domain, a phosphotransferase domain, a peptide synthetase domain, and an aminotransferase domain.

In another embodiment this invention provides an isolated polypeptide comprising a module where the module is specifically bound by an antibody that specifically binds to a leinamycin (lnm) module (e.g. is cross-reactive with an lnm polypeptide). In preferred embodiments, the polypeptide is specifically bound by an antibody that specifically binds to a polypeptide encoded by a leinamycin opening reading frame.

In certain embodiments, this invention provides an expression vector comprising any one or more of the nucleic acids described herein. The nucleic acids are preferably operably linked to a promoter (e.g. constitutive promoter, inducible promoter, tissue specific promoter, etc.). Also provided are host cells transfected and/or transformed with such a vector. Thus, in one embodiment this invention provides a host cell (e.g. a bacterial cell) transfected and/or transformed with an exogenous nucleic acid comprising a gene cluster encoding polypeptides sufficient to direct the assembly of a leinamycin or leinamycin analog and/or with a nucleic acid sufficient to introduce a modification into a lnm gene cluster (e.g. via homologous recombination). Particularly preferred cells include, but are not limited to, eukaryotic cells, insect cells, and bacterial cells (e.g. *Streptomyces* cells).

This invention also provides a method of chemically modifying a molecule. The method involves contacting a molecule that is a substrate for a polypeptide encoded by one or more leinamycin biosynthesis gene cluster open reading frames (e.g. a leinamycin intermediate metabolite) with a polypeptide encoded by one or more leinamycin biosynthesis gene cluster open reading frames, whereby the polypeptide chemically modifies the molecule. In preferred embodiments, the method comprises contacting the molecule with at least two, preferably at least 3, more preferably at least 4 and most preferably at least 5 different polypeptides encoded by leinamycin (lnm) gene cluster open reading frames. The contacting can be ex vivo or in a host cell (e.g. a bacterium such as *Streptomyces*). The molecule can include, but is not limited to, an endogenous metabolite produced by the host cell or an exogenous supplied metabolite. In certain embodiments, the cell is a eukaryotic cell (e.g. a mammalian cell, a yeast cell, a plant cell, a fungal cell, and an insect cell). In certain embodiments, the (substrate) molecule is an amino acid and the polypeptide is a peptide synthetase. In certain embodiments, the polypeptide is an amino transferase.

In still another embodiment, this invention provides a cell that overexpresses leinamycin. A particularly preferred cell overexpresses a polypeptide encoded by leinamycin open reading frame lnmG (SEQ ID NO 43) and/or lnmL (SEQ ID NO 48).

This invention also provides a method of coupling a first amino acid to a second amino acid. The method involves comprising contacting the first and second amino acid with a recombinantly expressed leinamycin nonribosomal peptide synthetase (NRPS) (e.g. NRPS-1, NRPS-2, etc.). The contacting can be ex vivo or in a host cell (e.g. a bacterium).

This invention also provides a method f coupling a first fatty acid to a second fatty acid. This method involves contacting the first and second fatty acids with a recombinantly expressed leinamycin polyketide synthase (PKS) (e.g. PKS-1, PKS-2, PKS-3, PKS-4, PKS-5, PKS-6). The contacting can be ex vivo or in a host cell (e.g. a bacterium).

In one embodiment, this invention provides a method of producing a leinamycin or leinamycin analog. The method involves providing a cell transformed with an exogenous nucleic acid comprising a leinamycin gene cluster encoding polypeptides sufficient to direct the assembly of the leinamycin or leinamycin analog; culturing the cell under conditions permitting the biosynthesis of leinamycin or leinamycin analog; and isolating the leinamycin or leinamycin analog from the cell.

In another embodiment, this invention provides a method of producing a leinamycin analog. The method involves providing a cell comprising a leinamycin gene cluster, transfecting the cell with a nucleic acid that alters the leinamycin gene cluster through homologous recombination, culturing the cell under conditions permitting the biosynthesis of the leinamycin analog; and isolating the leinamycin analog from the cell.

In still another embodiment, this invention provides an isolated nucleic acid comprising a nucleic acid encoding a phosphopantetheinyl transferase (PPTase) the nucleic acid encoding a phosphopantetheinyl transferase being selected from the group consisting of: 1) a nucleic acid encoding the protein comprising the amino acid sequence encoded by sap (Streptomyces altroolivaceus phosphopantetheinyl transferase) of FIG. 5; 2) a nucleic acid encoding a polypeptide having phosphopantetheinyl transferase activity where said nucleic acid specifically hybridizes to the nucleic acid having the sequence encoded by sap (Streptomyces altroolivaceus phosphopantetheinyl transferase) of FIG. 5 under stringent conditions. In a particularly preferred embodiment, the nucleic acid comprises the sequence of lmp in FIG. 5. As described above, the nucleic acid comprises a vector and cells comprising such a vector are provided herein. Also provided is a polypeptide encoded by a phosphopantetheinyl transferase nucleic acid described herein.

This invention also provides a method of converting an apo-carrier protein to a holo-carrier protein comprising reacting the apo-carrier protein with a recombinant phosphopantetheinyl transferase encoded by the lnm PPTase nucleic acid described herein and coenzyme A thereby producing a holo-carrier protein.

In still yet another embodiment, this invention provides a cell comprising a modified leinamycin gene cluster nucleic acid, where the cell produces elevated amounts of leinamycin as compared to the wild type cell. Particularly preferred cells overexpress a resistance gene from the leinamycin gene cluster (e.g. a resistance gene listed in Table 2).

This invention also provides antibodies that specifically bind to a polypeptide encoded by an lnm open reading frame identified in Table 2. The antibodies include, but are not limited to intact antibodies, antibody fragments, and single chain antibodies.

Based upon the present inventors' discovery that the leinamycin biosynthesis gene cluster utilizes a discrete AT, LmnG (SEQ ID NO 43), to provide acyltransferase activity in trans to a type I polyketide synthase lacking modular AT domains, the invention is further directed to methods exploiting this unique and useful observation. For example, the invention is further directed to methods of loading an extender molecule on an acyl carrier protein (ACP) domain including the step of contacting the ACP domain with the extender molecule and a recombinantly expressed, discrete acyl transferase (AT). The extender molecule is loaded onto the ACP domain by the catalytic activity of the discrete AT, provided in trans. The method may be carried out in vitro or in a host cell. If in a host cell, the host cell may be transformed with a vector comprising a nucleic acid encoding the discrete AT. In addition, the host cell may include a different vector comprising a nucleic acid encoding the ACP domain.

In one embodiment, the extender molecule may be selected from the group consisting of malonyl CoA, alkyl malonyl CoA (e.g., methyl, ethyl, or propionyl malonyl CoAs), acyl malonyl CoA, hydroxy malonyl CoA and alkoxy malonyl CoA (e.g., methoxy malonyl CoA). In another embodiment, the ACP domain may be selected from the group consisting of lnmI-ACP3, lnmJ-ACP4, lnmJ-ACP5, lnmJ-ACP6-1, lnmJ-ACP6-2, lnmJ-ACP7 and lnmJ-ACP8, descriptions of which are provided in a later Example and which are identified by the PCR primers SEQ ID NOs 230–247 as shown in Table 3. Furthermore, the ACP domain may be present within the modular structure of a type I PKS or type I PKS/NRPS.

In another embodiment, the discrete AT provided in trans comprises a polypeptide selected from the group consisting of: a catalytic domain encoded by SEQ ID NO:43; a catalytic domain encoded by a nucleic acid having the sequence of a nucleic acid amplified by PCR using the primer pair set forth in SEQ ID NO:155 and 156, respectively, using the nucleic acid of a leinamycin-producing organism as template; and a catalytic domain encoded by a nucleic acid that specifically hybridizes to SEQ ID NO:43 under stringent conditions.

In yet another method according to the invention, the ACP domain is present within a type I PKS module lacking a naturally-occurring acyl transferase domain or includes an acyl transferase domain which has been unnaturally rendered ineffective for loading the extender molecule to said ACP domain. The AT domain may also be selected from the group of polypeptides consisting of PksC/PksD/PksE-AT (SEQ ID NO 253, 250 and 254, respectively) (from *Bacillus subtilis*), PedC/PedD (SEQ ID NO 251 and 255) (from a bacterial symbiont of *Paederus* beetles), MmpIII-AT1/AT2 SEQ ID NO 252 and 256) (from *Pseudomonas fluorescens*), FenF (SEQ ID NO 258) (from *Bacillus subtilis*), Mx-TaK (SEQ ID NO 265) (from *Myxococcus xanthus*), LnmG (SEQ ID NO 43) (from *Streptomyces atroolivaceus*) or another LnmG homolog.

The present invention is also directed to methods of loading an extender molecule on a type I polyketide synthase (PKS) module, including the step of contacting said type I PKS module with the extender molecule and a recombinantly expressed discrete acyl transferase (AT), whereby the extender molecule is loaded onto the type I PKS module by the acyl transferase catalytic activity of the discrete AT, provided in trans.

In yet another embodiment of the invention, methods for producing a polyketide or polyketide/nonribosomal peptide hybrid or analog are provided. These methods include the steps of: providing a type I polyketide synthase (PKS) or type I PKS/nonribosomal protein synthetase (PKS/NRPS) including a module lacking an acyltransferase (AT) domain or including an acyltransferase domain which has been unnaturally rendered ineffective for loading the extender molecule on said module; contacting the PKS or NRPS with a recombinantly-expressed, discrete acyltransferase (AT) wherein the discrete AT is catalytically active in loading an extender molecule onto the module lacking in acyl transferase activity; incubating under conditions permitting the biosynthesis of the polyketide or polyketide/nonribosomal peptide or analog thereof; and isolating the polyketide or polyketide/nonribosomal peptide or analog thereof. Such methods are preferably carried out in a host cell. More preferably, the host cell includes a vector comprising a nucleic acid encoding the discrete AT. Alternatively, the host cell includes an additional but different vector comprising a nucleic acid encoding the ACP domain.

Definitions

The term "polyketide synthases" (PKSs) refers to multifunctional enzymes, related to fatty acid synthases (FASs). PKSs catalyze the biosynthesis of polyketides through repeated (decarboxylative) Claisen condensations between acylthioesters, usually acetyl, propionyl, malonyl or methylmalonyl. Following each condensation, they typically introduce structural variability into the product by catalyzing all, part, or none of a reductive cycle comprising a ketoreduction, dehydration, and enoylreduction on the β-keto group of the growing polyketide chain. PKSs incorporate enormous structural diversity into their products, in addition to varying the condensation cycle, by controlling the overall chain length, choice of primer and extender units and, particularly in the case of aromatic polyketides, regiospecific cyclizations of the nascent polyketide chain. After the carbon chain has grown to a length characteristic of each specific product, it is typically released from the synthase by thiolysis or acyltransfer. Thus, PKSs consist of families of enzymes which work together to produce a given polyketide. Two general classes of PKSs exist. One class, known as Type I PKSs, is represented by the PKSs for macrolides such as erythromycin. These "complex" or "modular" PKSs include assemblies of several large multifunctional proteins carrying, between them, a set of separate active sites for non-iteratively carrying out each step of carbon chain assembly and modification (Cortes et al. (1990) *Nature* 348: 176; Donadio et al. (1991) *Science* 252: 675; MacNeil et al. (1992) *Gene* 115: 119). Structural diversity occurs in this class from variations in the number and type of active sites in the PKSs. This class of PKSs displays a one-to-one correlation between the number and clustering of active sites in the primary sequence of the PKS and the structure of the polyketide backbone. The second class of PKSs, called Type II PKSs, is represented by the synthases for aromatic compounds. Type II PKSs typically have a single set of iteratively used active sites (Bibb et al. (1989) *EMBO J.* 8: 2727; Sherman et al. (1989 (*EMBO J.* 8: 2717; Fernandez-Moreno, et al. (1992) *J. Biol. Chem.* 267: 19278).

A "nonribosomal peptide synthase" (NRPS) refers to an enzymatic complex of eukaryotic or prokaryotic origin, that is responsible for the synthesis of peptides by a nonribosomal mechanism, often known as thiotemplate synthesis (Kleinkauf and von Doehren (1987) *Ann. Rev. Microbiol.*, 41: 259–289). Such peptides, which can be up to 20 or more amino acids in length, can have a linear, cyclic (cyclosporin, tyrocidine, mycobacilline, surfactin and others) or branched cyclic structure (polymyxin, bacitracin and others) and often contain amino acids not present in proteins or modified amino acids through methylation or epimerization.

A "module" refers to a set of distinctive polypeptide domains that encode all the enzyme activities necessary for one cycle of polyketide or peptide chain elongation and associated modifications.

The terms "isolated" "purified" or "biologically pure" refer to material which is substantially or essentially free from components which normally accompany it as found in its native state. With respect to nucleic acids and/or polypeptides the term can refer to nucleic acids or polypeptides that are no longer flanked by the sequences typically flanking them in nature.

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The term also includes variants on the traditional peptide linkage joining the amino acids making up the polypeptide.

The terms "nucleic acid" or "oligonucleotide" or grammatical equivalents herein refer to at least two nucleotides covalently linked together. A nucleic acid of the present invention is preferably single-stranded or double stranded and will generally contain phosphodiester bonds, although in some cases, as outlined below, nucleic acid analogs are included that may have alternate backbones, comprising, for example, phosphoramide (Beaucage et al. (1993) *Tetrahedron* 49(10): 1925) and references therein; Letsinger (1970) *J. Org. Chem.* 35:3800; Sprinzl et al. (1977) *Eur. J. Biochem.* 81: 579; Letsinger et al. (1986) *Nucl. Acids Res.* 14: 3487; Sawai et al. (1984) *Chem. Lett.* 805, Letsinger et al. (1988) *J. Am. Chem. Soc.* 110: 4470; and Pauwels et al. (1986) *Chemica Scripta* 26: 1419), phosphorothioate (Mag et al. (1991) *Nucleic Acids Res.* 19:1437; and U.S. Pat. No. 5,644,048), phosphorodithioate (Briu et al. (1989) *J. Am. Chem. Soc.* 111:2321, O-methylphophoroamidite linkages (see Eckstein, *Oligonucleotides and Analogues: A Practical Approach*, Oxford University Press), and peptide nucleic acid backbones and linkages (see Egholm (1992) *J. Am. Chem. Soc.* 114:1895; Meier et al. (1992) *Chem. Int. Ed. Engl.* 31: 1008; Nielsen (1993) *Nature*, 365: 566; Carlsson et al. (1996) *Nature* 380: 207). Other analog nucleic acids include those with positive backbones (Denpcy et al. (1995) *Proc. Natl. Acad. Sci. USA* 92: 6097; non-ionic backbones (U.S. Pat. Nos. 5,386,023, 5,637,684, 5,602,240, 5,216,141 and 4,469,863; Angew. (1991) *Chem. Intl. Ed. English* 30: 423; Letsinger et al. (1988) *J. Am. Chem. Soc.* 110:4470; Letsinger et al. (1994) *Nucleoside & Nucleotide* 13:1597; Chapters 2 and 3, ASC Symposium Series 580, "Carbohydrate Modifications in Antisense Research", Ed. Y. S. Sanghui and P. Dan Cook; Mesmaeker et al. (1994), *Bioorganic & Medicinal Chem. Lett.* 4: 395; Jeffs et al. (1994) *J. Biomolecular NMR* 34:17; *Tetrahedron Lett.* 37;743 (1996) and non-ribose backbones, including those described in U.S. Pat. Nos. 5,235,033 and 5,034,506, and Chapters 6 and 7, ASC Symposium Series 580, *Carbohydrate Modifications in Antisense Research*, Ed. Y. S. Sanghui and P. Dan Cook. Nucleic acids containing one or more carbocyclic sugars are also included within the definitions of nucleic acids (see Jenkins et al. (1995), *Chem. Soc. Rev.* pp 169–176). Several nucleic acid analogs are described in Rawls, C & E News Jun. 2, 1997 page 35. These modifications of the ribose-phosphate backbone may be done to facilitate the addition of additional moieties such as labels, or to increase the stability and half-life of such molecules in physiological environments.

The term "heterologous" as it relates to nucleic acid sequences such as coding sequences and control sequences, denotes sequences that are not normally associated with a region of a recombinant construct, and/or are not normally associated with a particular cell. Thus, a "heterologous" region of a nucleic acid construct is an identifiable segment of nucleic acid within or attached to another nucleic acid molecule that is not found in association with the other molecule in nature. For example, a heterologous region of a construct could include a coding sequence flanked by sequences not found in association with the coding sequence in nature. Another example of a heterologous coding sequence is a construct where the coding sequence itself is not found in nature (e.g., synthetic sequences having codons different from the native gene). Similarly, a host cell transformed with a construct which is not normally present in the host cell would be considered heterologous for purposes of this invention.

A "coding sequence" or a sequence that "encodes" a particular polypeptide (e.g. a PKS, an NRPS, etc.), is a nucleic acid sequence which is ultimately transcribed and/or translated into that polypeptide in vitro and/or in vivo when placed under the control of appropriate regulatory sequences. In certain embodiments, the boundaries of the coding sequence are determined by a start codon at the 5' (amino) terminus and a translation stop codon at the 3' (carboxy) terminus. A coding sequence can include, but is not limited to, cDNA from prokaryotic or eukaryotic mRNA, genomic DNA sequences from prokaryotic or eukaryotic DNA, and even synthetic DNA sequences. In preferred embodiments, a transcription termination sequence will usually be located 3' to the coding sequence.

Expression "control sequences" refers collectively to promoter sequences, ribosome binding sites, polyadenylation signals, transcription termination sequences, upstream regulatory domains, enhancers, and the like, which collectively provide for the transcription and translation of a coding sequence in a host cell. Not all of these control sequences need always be present in a recombinant vector so long as the desired gene is capable of being transcribed and translated.

"Recombination" refers to the reassortment of sections of DNA or RNA sequences between two DNA or RNA molecules. "Homologous recombination" occurs between two DNA molecules which hybridize by virtue of homologous or complementary nucleotide sequences present in each DNA molecule.

The terms "stringent conditions" or "hybridization under stringent conditions" refers to conditions under which a probe will hybridize preferentially to its target subsequence, and to a lesser extent to, or not at all to, other sequences. "Stringent hybridization" and "stringent hybridization wash conditions" in the context of nucleic acid hybridization experiments such as Southern and northern hybridizations are sequence dependent, and are different under different environmental parameters. An extensive guide to the hybridization of nucleic acids is found in Tijssen (1993) *Laboratory Techniques in Biochemistry and Molecular Biology—Hybridization with Nucleic Acid Probes part I chapter 2 Overview of principles of hybridization and the strategy of nucleic acid probe assays*, Elsevier, New York. Generally, highly stringent hybridization and wash conditions are selected to be about 5° C. lower than the thermal melting point ($T_m$) for the specific sequence at a defined ionic strength and pH. The $T_m$ is the temperature (under defined ionic strength and pH) at which 50% of the target sequence hybridizes to a perfectly matched probe. Very stringent conditions are selected to be equal to the $T_m$ for a particular probe.

An example of stringent hybridization conditions for hybridization of complementary nucleic acids which have more than 100 complementary residues on a filter in a Southern or northern blot is 50% formamide with 1 mg of heparin at 42 C, with the hybridization being carried out overnight. An example of highly stringent wash conditions is 0.15 M NaCl at 72 C for about 15 minutes. An example of stringent wash conditions is a 0.2×SSC wash at 65 C for 15 minutes (see, Sambrook et al. (1989) *Molecular Cloning—A Laboratory Manual* (2$^{nd}$ ed.) Vol. 1–3 Cold Spring Harbor Laboratory, Cold Spring Harbor Press, NY, for a description of SSC buffer). Often, a high stringency wash is preceded by a low stringency wash to remove background probe signal. An example medium stringency wash for a duplex of, e.g., more than 100 nucleotides, is 1×SSC at 45 C for 15 minutes. An example low stringency wash for a duplex of, e.g., more than 100 nucleotides, is 4–6×SSC at 40 C for 15 minutes. In general, a signal to noise ratio of 2× (or higher) than that observed for an unrelated probe in the particular hybridization assay indicates detection of a specific hybridization. Nucleic acids which do not hybridize to each other under stringent conditions are still substantially identical if the polypeptides which they encode are substantially identical. This occurs, e.g., when a copy of a nucleic acid is created using the maximum codon degeneracy permitted by the genetic code.

A "library" or "combinatorial library" of polyketides and/or polypeptides is intended to mean a collection of polyketides and/or polypeptides (or other molecules) catalytically produced by a PKS and/or NRPS and/or hybrid PKS/NRPS (or other possible combination of synthetic elements) gene cluster. The library can be produced by a gene cluster that contains any combination of native, homolog or mutant genes from aromatic, modular or fungal PKSs and/or NRPSs. The combination of genes can be derived from a single PKS and/or NRPS gene cluster, e.g., act, fren, gra, tcm, whiE, gris, ery, or the like, and may optionally include genes encoding tailoring enzymes which are capable of catalyzing the further modification of a polypeptide, polyketide, or other molecule. Alternatively, the combination of genes can be rationally or stochastically derived from an assortment of NRPS and/or PKS gene clusters. The library of polyketides and/or polypeptides and/or other molecules thus produced can be tested or screened for biological, pharmacological or other activity.

By "random assortment" is intended any combination and/or order of genes, homologs or mutants which encode for the various PKS and/or NRPS enzymes, modules, active sites or portions thereof derived from aromatic, modular or fungal PKS and/or NRPS gene clusters.

By "genetically engineered host cell" is meant a host cell where the native PKS and/or NRPS gene cluster has been altered or deleted using recombinant DNA techniques or a host cell into which heterologous PKS and/or NRPS and/or hybrid PKS/NRPS gene cluster has been inserted. Thus, the term would not encompass mutational events occurring in nature. A "host cell" is a cell derived from a prokaryotic microorganism or a eukaryotic cell line cultured as a unicellular entity, which can be, or has been, used as a recipient for recombinant vectors bearing the PKS, NRPS, and/or hybrid gene clusters of the invention. The term includes the progeny of the original cell which has been transfected. It is understood that the progeny of a single parental cell may not necessarily be completely identical in morphology or in genomic or total DNA complement to the original parent, due to accidental or deliberate mutation. Progeny of the parental cell which are sufficiently similar to the parent to be characterized by the relevant property, such as the presence of a nucleotide sequence encoding a desired PKS, are included in the definition, and are covered by the above terms.

"Expression vectors" are defined herein as nucleic acid sequences that direct the transcription of cloned copies of genes/cDNAs and/or the translation of their mRNAs in an appropriate host. Such vectors can be used to express genes or cDNAs in a variety of hosts such as bacteria, bluegreen algae, plant cells, insect cells and animal cells. Expression vectors include, but are not limited to, cloning vectors, modified cloning vectors, specifically designed plasmids or viruses. Specifically designed vectors allow the shuttling of DNA between hosts, such as bacteria-yeast or bacteria-animal cells. An appropriately constructed expression vector preferably contains: an origin of replication for autonomous replication in a host cell, as electable marker, optionally one or more restriction enzyme sites, optionally one or more constitutive or inducible promoters. In preferred embodiments, an expression vector is a replicable DNA construct in which a DNA sequence encoding a one or more PKS and/or NRPS domains and/or modules is operably linked to suitable control sequences capable of effecting the expression of the products of these synthase and/or synthetases in a suitable host. Control sequences include a transcriptional promoter, an optional operator sequence to control transcription and sequences that control the termination of transcription and translation, and so forth.

A "leinamycin (Lnm) open reading frame", or "ORF", or "Lnm Orf" refers to a nucleic acid open reading frame that encodes a polypeptide or polypeptide domain that has an enzymatic activity used in the biosynthesis of a leinamycin.

A "PKS/NRPS/PKS" system refers to a synthetic system comprising an NRPS flanked by two PKSs. A "NRPS/PKS/NRPS" system refers to a synthetic system comprising a PKS flanked by two NRPSs. A "hybrid PKS/NRPS system" or a "hybrid NRPS/PKS system" refers to a hybrid synthetic system comprising at least one PKS and one NRPS module. The system can comprise multiple modules and the order can vary.

A "biological molecule that is a substrate for a polypeptide encoded by a leinamycin biosynthesis gene" refers to a molecule that is chemically modified by one or more polypeptides encoded by open reading frame(s) of the Lnm gene cluster. The "substrate" may be a native molecule that typically participates in the biosynthesis of a leinamycin, or can be any other molecule that can be similarly acted upon by the polypeptide.

A "polymorphism" is a variation in the DNA sequence of some members of a species. A polymorphism is thus said to be "allelic," in that, due to the existence of the polymorphism, some members of a species may have the unmutated sequence (i.e. the original "allele") whereas other members may have a mutated sequence (i.e. the variant or mutant "allele"). In the simplest case, only one mutated sequence may exist, and the polymorphism is said to be diallelic. In the case of diallelic diploid organisms, three genotypes are possible. They can be homozygous for one allele, homozygous for the other allel or heterozygous. In the case of diallelic haploid organisms, they can have one allele or the other, thus only two genotypes are possible. The occurrence of alternative mutations can give rise to trialleleic, etc. polymorphisms. An allele may be referred to by the nucleotide(s) that comprise the mutation.

"Single nucleotide polymorphism" or "SNPs" are defined by their characteristic attributes. A central attribute of such a polymorphism is that it contains a polymorphic site, "X," most preferably occupied by a single nucleotide, which is the site of the polymorphism's variation (Goelet and Knapp U.S. patent application Ser. No. 08/145,145). Methods of identifying SNPs are well known to those of skill in the art (see, e.g., U.S. Pat. No. 5,952,174).

"Homologous", as used herein, refers to the sequence similarity between two polypeptide molecules or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared times 100. For example, if 6 of 10, of the positions in two sequences are matched or homologous then the two sequences are 60% homologous. By way of example, the DNA sequences ATTGCC and TATGGC share 50% homology. Generally, a comparison is made when two sequences are aligned to give maximum homology.

The following abbreviations are used herein: A, adenylation; ACP, acyl carrier protein; AT, acyltransferase, lnm, leinamycin; C, condensation; CL, co-enzyme A ligase; Cy, condensation/cyclization; DH, dehydratase; ER, enoyl reductase; KR, ketoreductase; KS, ketoacyl synthase; MT, methyltransferase; NRPS, nonribosomal peptide synthetase; orf, open reading frame; Ox, oxidation; PCP, peptidyl carrier protein; PCR, polymerase chain reaction; PKS, polyketide synthase; ACP, aryl carrier protein, bp, base pair, CoA, co-enzyme A, DTT, dithiothreitol; FAS, fatty acid synthase; kb, kilobase; PPTase, 4'-phosophopantetheinyl transferase; TCA, triloroacetic acid; TE, thioesterase.

BRIEF DESCRIPTION OF THE DRAWINGS

FIG. 5 alignment of *Streptomyces lnm pptase with pptase fragments from other species*. SC5A7 (SEQ ID NO:223), color (SEQ ID NO:224), Svp (SEQ ID NO:225), gris (SEQ ID NO:226), albus (SEQ ID NO:227), lnm (SEQ ID NO:228), consensus (SEQ ID NO:229).

FIGS. 9–9C illustrate the production of novel leinamycins by engineering leinamycin biosynthesis. FIG. 9C showed that inactivation of either one of the two P-450 hydroxylases (LnmA or LnmZ) can lead to the production of new leinamycins, one of which could be the 8-dehydroxyl-Lnm showed in FIG. 7.

FIG. 15 depicts multiple sequence alignment performed by the CLUSTAL W program (version 1.81), using Gonnet series weight matrix with a gap open penalty of 10.00 and a gap extension penalty of 0.2.

DETAILED DESCRIPTION

Figure 1:
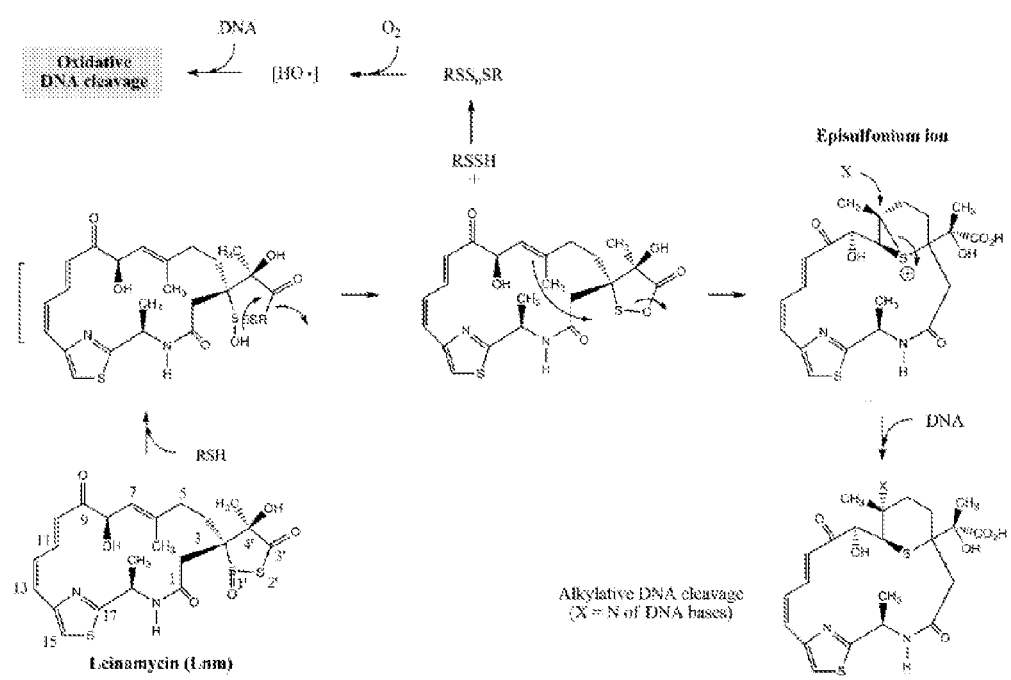
FIG. 1 illustrates the structure of leinamycin (Lnm) and the proposed mechanism for its oxidative and alkylative DNA-cleavage.

This invention pertains to the isolation, identification, and characterization of the gene clusters that directs synthesis of Leinamycin (Lnm). In addition, the invention pertains to uses of various elements of the Lnm cluster, in particular, LnmG. Leinamycin is a macrolactam of hybrid polyketide and nonribosomal peptide origin with an unprecedented 1,3-dioxo-1,2-dithiolane structure. Lnm shows potent antitumor activity in tumor models in vivo, including those that are resistant to clinically important anticancer drugs. Although Lnm analogs with improved antitumor activity have been generated by chemical modifications, supporting the wisdom of making novel anticancer drugs based on the Lnm scaffold, development of Lnm into a clinical anticancer drug has been hampered by the in vivo instability of natural Lnm.

Genetic manipulations of both polyketide and nonribosomal peptide biosynthesis have generally been very successful in generating novel "unnatural" natural products. In a similar manner, extension of these genetic-based approaches, also known as "Combinatorial Biosynthesis," to Lnm biosynthesis provides the ability to generate novel Lnm analogs, which are expected to provide useful "lead compounds" for the development of novel anticancer drugs.

The leinamycin synthetic pathway described herein utilizes a hybrid polyketide-peptide biosynthesis. Polyketides and polypeptides can be assembled in a remarkably similar manner by repetitive addition of an extending unit to a growing chain by polyketide synthases (PKS) and nonribosomal peptide synthetase (NRPS) respectively. In the case of polyketides, the extending unit is typically a fatty acid (activated as an acyl CoA thioester) while the extending unit for polypeptides is typically an amino acid (activated as an aminoacyl adenylate). Both the PKS and NPRS systems have evolved a modular organization to define the number, sequence, and specificity of the incorporation of the extending unit and utilized the 4'-phosphopanththeine prosthetic group to channel the growing intermediate during the elongation process.

Polyketide metabolites display enormous structural diversity, yet share a common mechanism of biosynthesis. The carbon backbones of polyketides are assembled from short carboxylic acids by sequential decarboxylative condensation, and this process is catalyzed by PKSs. Two types of bacterial PKSs have been characterized to explain the polyketide biochemistry (Katz and Donadio (1993) *Ann. Rev. Microbiol.* 47: 875–912; Hutchinson and Fuji, (1995) *Ann. Rev. Microbiol.* 49: 201–38; Cane (1997) *Chem. Rev.* 97: 2463–2705; Carreras et al. (1997) *Top. Curr. Chem.* 188: 85–126; Cane, et al. (1998) *Science* 282: 63–68; Staunton and Wilkinson (1998) *Top. Curr. Chem.* 195:49–92; Hopwood and Sherman (1990) *Ann. Rev. Genet.* 24: 37–66). Type I enzymes are multifunctional proteins that harbor sets of noniteratively used distinct active sites, termed modules, for the catalysis of each cycle of polyketide chain elongation in biosynthesis of reduced polyketides like macrolide, polyether, or polyene antibiotics (Cane (1997) *Chem. Rev.* 97: 2463–2705; Carreras et al. (1997) *Top. Curr. Chem.* 188: 85–126; Staunton and Wilkinson (1998) *Top. Curr. Chem.* 195: 49–92). Type II enzymes are multienzyme complexes that carry a single set of iteratively-used activities and consist of several monofunctional proteins for the synthesis of aromatic polyketides like tetracyclines (Cane (1997) *Chem. Rev.* 97: 2463–2705). The growing polyketide intermediates in both systems remain covalently attached to the acyl carrier protein (ACP) of the PKS enzyme via the 4'-phosphopantetheine cofactor during the elongation process (Shen, et al. (1997) *J. Bacteriol.*, 174: 3818–3821; Carreras and Khosla (1998) *Biochemistry* 37: 2084–2088).

Nonribosomal peptides, a structurally diverse family of bioactive peptides, are assembled nonribosomally from both proteinogenic and nonproteinogenic amino acids, and this process is catalyzed by NRPSs. Remarkably, NRPS possess a similar multimodular structure as type I PKSs, and these modules represent the functional building units of an NRPS that activate, modify and link together by amide or ester bonds the constituent amino acids of the peptide product (Cane (1997) *Chem. Rev.* 97: 2463–2705; Carreras et al. (1997) *Top. Curr. Chem.* 188: 85–126; Cane, et al. (1998) *Science* 282: 63–68; Cane and Walsh (1999) *Chem. Biol.* 6: R319–R325; Konz and Marahiel (1999) *Chem. Biol.* 6: R39–R48; von Döhren et al. (1999) *Chem. Biol.* 6: R273–R279). Modules can be either physically linked together, or interact noncovalently via protein/protein recognition to form the protein template that dictates the number and sequence of the amino acids incorporated into the peptide products. Individual modules are characterized by domains that catalyze the activation of constituent amino acids as acyladenylates (A domain) (Weinreb et at. (1998) *Biochemistry* 37:1575–1584: Stachlhaus and Marahiel (1995) *J. Biol. Chem.* 270: 6163–6169; Konz et al. (197) *Chem. Biol.* 4: 927–937; Mootz and Marahiel (1997) *J. Bacteriol.* 179: 6843–6850; Stachelhaus et al. (1999) *Chem. Biol.*, 6: 493–505; Challis et al. (2000) *Chem. Biol.* 7: 211–224), the thioesterification of the activated amino acids with the sulfhydryl group of the 4'-phosphopantetheine cofactor that is covalently bound to the C-terminal region of each amino acid activating domain (thiolation domain or PCP) (Gehring et al. (1997) *Chem. Biol.* 4: 17–24; Lambalot et al. (1996) *Chem. Biol.* 3:923–936; Weinreb et al. (1998) *Biochemistry* 37: 1575–1584; Stachlhaus and Marahiel (1995) *J. Biol. Chem.* 270: 6163–6169; Konz et al. (197) *Chem. Biol.* 4:927–937; Mootz and Marahiel (1997) *J. Bacteriol.* 179: 6843–6850; Stachelhaus et al. (1999) *Chem. Biol.*, 6: 493–505; Challis et al. (2000) *Chem. Biol.* 7:211–224; Stachelhaus et al. (1996) *Chem. Biol.* 3: 913–921; Pfeifer et al. (1995) *Biochemistry*, 34: 7450–7459; Haese et al. (1994) *J. Mol. Biol.* 243: 116–122; Quadri et al. (1998) *Bilchemistry*, 37: 1585–1595; Rose et al. (1998) *Nucleic Acids Res.*, 26: 1628–1635; Ku et al. (1997) *Chem. Biol.*, 4: 203–207; Reuter et al. (1999) *EMBO J.*, 18: 6823–6831), and the transpeptidation of carboxy thioester activated amino acids between the aligned domains, resulting in the formation of a specific peptide chain with a defined sequence (condensation or C domain) (Stachlhaus et al. (1998) *J. Biol. Chem.*, 273: 22773–22781).

Additional domains have also been identified that are responsible for the modification of the peptide product, such as epimerization (E) domains for the conversion of L-amino acids to D-amino acids (Marahiel et al. (1997) *Chem. Rev.*, 97: 2651–2673), N-methyltransferase (MT) domains for the addition of methyl groups to the amide nitrogen (Id.), cyclization (Cy) domains for the formation of heterocyclic rings (Konz et al. (197) *Chem. Biol.* 4: 927–937), a reduction domain for reductive release of an aldehyde product (Ehmann et al. (1999) *Biochemistry*, 38: 6171–6177), and oxidation domains for the thiazolidine-to-thiazole oxidation (Ox) (Molnar et al. (1999) *Chem. Biol.*, 7: 97–109) or for α-hydroxylation of the incorporated amino acid (Ox') (Silakowski et al. (1999) *J. Biol. Chem.*, 274: 37391–37399).

Hybrid peptide-polyketide metabolites, such as leinamycin, are structurally characterized by both the amino acid and the carboxylic acid building blocks. The assembly of hybrid peptide-polyketide metabolites from amino acids and carboxylic acids is catalyzed by a hybrid NRPS-PKS system that bears the characteristics of both NRPS and PKS (Du et al. (2001) *Metabolic Eng.* 3: 78–95; Du and Shen (2001) *Curr. Opinion Drug Discov. Dev.* 4: 215–228). The interacting NRPS and PKS modules can be either covalently linked by arranging the catalytic domains in a linear order on the same protein, or physically located on two or more separate proteins, utilizing specific protein—protein recognition to ensure the correct pairing between the interacting modules. One such hybrid system is exemplified by the bleomycin biosynthesis, BlmIX NRPS/Blm VIII PKS/Blm VII NRPS system, combining the features of both hybrid NRPS/PKS and PKS/NRPS systems (see e.g. USSN PCT/US00/0045; Shen et al. (1999) *Bioorg. Chem.*, 27: 155–171).

In one aspect, this invention provides a cloned and characterized (LNM) leinamycin gene cluster (~61.3 kb) consisting of characteristic NRPS and PKS genes from the (lnm) leinamycin producer *Streptomyces atroolivaceus*. The cloned and isolated (lnm) leinamycin gene cluster and subunits (e.g. ORFs) thereof provides a method of recombinantly expressing leinamycin and/or leinamycin analogues. Thus, in one embodiment, this invention provides for nucleic acids encoding leinamycin synthetic machinery or subunits thereof, for cells recombinantly modified to express a leinamycin and/or leinamycin analogue, and for a leinamycin or leinamycin analogue recombinantly expressed in such cells.

Like other polyketide synthase or nonribosomal peptide synthetases, the leinamycin synthetic pathway is organized into modules, each module catalyzing the addition and/or modification of one subunit (e.g. fatty acid and/or amino acid). Each module is organized into a number of domains each domain having a characteristic activity (e.g. activation, condensation, condensation, cyclization, etc.). The catalytic domain within a module and the modules themselves are often arranged collinearly and the order of biosynthetic modules from $NH_2$— to COOH-terminus on each PKS and NRPS polypeptide and the number and type of catalytic domains within each determine the order of structural and functional elements in the resulting product.

The size and complexity of the ultimately formed product are controlled, in part, by the number of repeated acyl chain extension steps that are, in turn, a function of the number and placement of carrier protein domains in these multimodular enzymes. The number composition and order of such domains can be altered either to introduce modifications, e.g. into the leinamycin to produce leinamycin analogues, or to produce different or completely new molecules. Such "recombination" is not restricted solely to recombination among the leinamycin catalytic domains and/or modules, but can also involve recombination between leinamycin modules and/or subunits and other PKS and/or NRPS modules and/or subunits (e.g. bleomycin subunits). Moreover the discovery that synthetic pathways can incorporate both PKS and NRPS modules and/or catalytic domains makes available hybrid PKS/NRPS synthases.

Thus, in one embodiment this invention contemplates the use of lnm gene cluster modules and/or catalytic domains to make various peptide and/or polyketide, and/or hybrid polypeptide/polyketide metabolites (including, but not limited to leinamycin, leinamycin intermediates or shunt metabolites), in combinatorial biosynthesis with other polyketide synthases and/or other nonribosomal peptide synthetases.

In particular, it is noted that the various lnm ORFs show characteristic enzymatic activities including, but not limited to aminotransferases, peptide synthetases, thioesterases, decarboxylases, and the like. The proteins encoded by these orfs can be used alone, or in combination with other active domains to modify various target substrates.

This invention also includes the discovery and characterization of a novel PPTase (a fragment of which is shown and named lmn in FIG. 5). This PPTase can be cloned and used in engineered biosynthesis of polyketides, peptides, hybrid peptide and polyketide metabolites, hybrid polyketide and peptide metabolites, or the combination of both types of metabolites. The PPTase can also be used in converting apo-peptidyl carrier proteins (both type I and type II) and acyl carrier proteins (both type I and type II) into the holo-proteins.

In certain preferred embodiments, this invention contemplates the use of leinamycin (lnm) gene cluster modules and/or catalytic domains to produce leinamycin (e.g. to upregulate endogenous leinamycin production to permit leinamycin production in cells other than *Streptomyces*, etc.) and/or to make veious modified leinamycins (leinamycin analogues).

The Examples provided herein and the accompanying primers permit one of ordinary skill in the art to isolate the (lnm) leinamycin gene cluster of this invention, its constituent orfs, various modules, or enzymatic domains. The isolated nucleic acid components can be used to express one or more polypeptide components for in vivo (e.g. recombinant) synthesis of one or more polypeptides and/or polyketides as indicated above. It will also be appreciated that the (lnm) leinamycin cluster polypeptides can be used for ex vivo assembly of various macromolecules.

I. Biosynthetic Pathway for Leinamycin in S. atroolivaceus.

Figure 4:
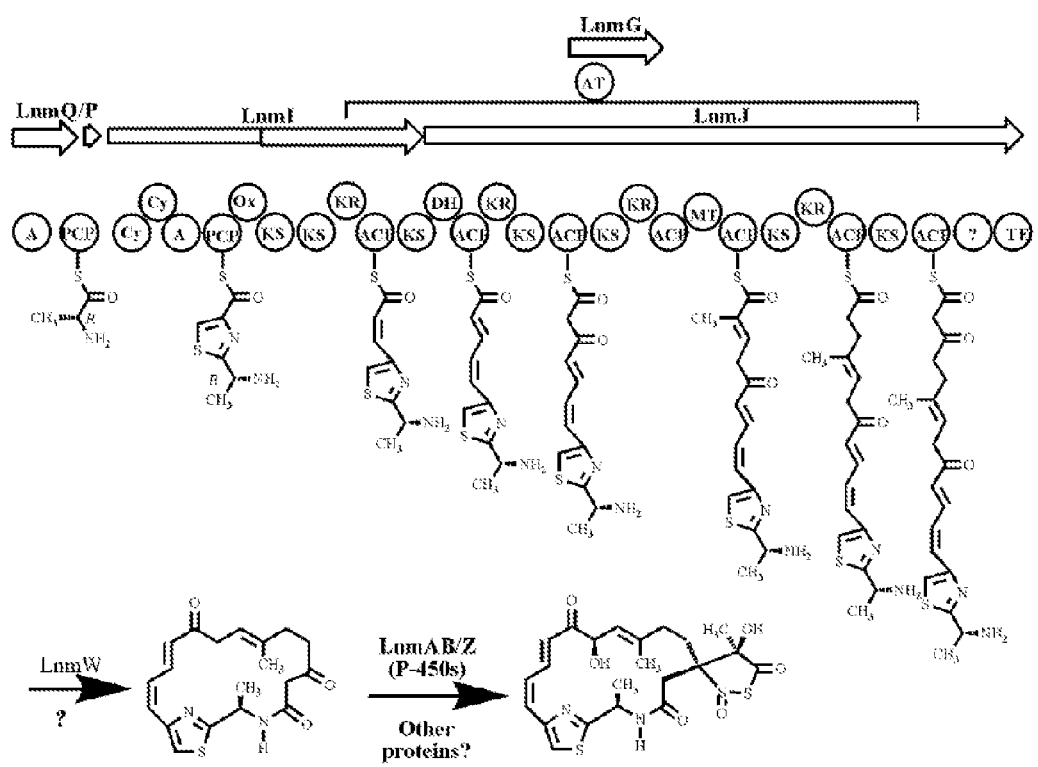
FIG. 4 illustrates a proposed Lnm biosynthetic pathway in *S. altroolivaceus* involving a hybrid NRPS/PKS. Abbreviations: A, adenylation; ACP, acyl carrier protein; AT, acyltransferase; C, condensation; CL, co-enzyme A ligase; Cy, condensation; cyclization; DH, dehydratase; ER, enoyl reductase; KR, ketoreductase; KS, ketoacyl synthase; Ox, oxidation; MT, methyltransferase; PCP, peptidyl carrier protein; TE, thioesterase.

Without being bound to a particular theory, it is believed that the genetic organization of the lnm gene cluster and the enzymology of Lnm biosynthesis closely parallels that of macrolide and hybrid peptide-polyketide metabolites such as bleomycin. The structural similarity of Lnm to macrolides in general and to thiazole-containing hybrid peptide-polyketide metabolites such as bleomycin in particular provides substantial data on a pathway for Lnm biosynthesis. We believe the synthesis of the Lnm macrolactam backbone involves a hybrid NRPS/PKS system consisting of 2 NRPS and 6 PKS modules, which, at each step, specify the amino acid or carboxylic acid to be incorporated, and the modifications associated with this particular cycle of elongation (FIG. 4). In such a hybrid NRPS/PKS biosynthesis (FIG. 4), Lnm biosynthesis starts with an NRPS module, NRPS-1, that activates L-alanine as an amino acylthioester and epimerizes the latter into D-alanine to set the stage for Lnm biosynthesis. In certain embodiments, however, D-alanine can be a direct substrate for NRPS-1. NRPS-2 generally specifies L-cysteine is typically characterized by the signature Cy and Ox domains for thiazole formation. The NRPS-2-bound peptidyl intermediate is next elongated by the PKS-1 module, the KS domain of which is homologous to the KSs known to interact with NPRS modules in NRPS/PKS hybrids (PCT/US00/00445) and the ACP domain of which is loaded by the acyltransferace (AT) domain of lnmG that should specify for malonyl CoA as an extender unit (Haydock et al. (1995) FEBS Lett., 374: 246–248).

Chain elongation proceeds by sequential incorporation of five additional molecules of malonyl CoA, utilizing five additional PKS modules, PKS-2, PKS-3, PKS-4, PKS-5, and PKS-6. The loading of malonyl CoA to the ACP domains of all five PKS modules is catalyzed by the same AT domain of lnmG whose substrate specificity for malonyl CoA as the extender unit for individual PKS modules is easily determined from sequence analysis of the AT domains (Haydock et al. (1995) FEBS Lett., 374: 246–248). Since the AT domain of lnmG calls for malonyl CoA as an extender unit for all six PKS modules, an additional hydroxylation step must have taken place for the introduction of the methyl group at C-6. Macrolide ring hydroxylation is often catalyzed by cytochrome P-450 hydroxylases that have been identified from several macrolide biosynthesis gene clusters (Rodriguez et al. (1995) FEMS Microbiol. Lett., 127: 117–120; Weber et al. (1991) Science, 252: 114–117; Xue et al. (1998) Chem. Biol,. 5: 661–667).

Candidates for these types of hydroxylases have indeed been identified for leinamycin biosynthesis, such as lnmA, lnmB, and lnmZ (FIG. 4). Methylation of macrolide ring has been noted before, deriving the methyl group from S-adenosylmenthionine (AdoMet) and catalyzed by a methyl transferase domain (Due et al. (2000) Chem. Biol., 7: 623–642). An MT domain has been identified in PKS4 of lnmJ, which presumably is responsible for the introduction of the C-6 methyl group of leinamycin (FIG. 4). Finally, modeled on rafamycin biosynthesis—the only macrolactam whose biosynthesis gene cluster has been characterized to date (August et al. (1998) Chem. Biol., 5:69–79), we propose that a discrete amide synthase catalyzes the release of the full length peptide/polyketide intermediate from the Lnm synthase complex and the cyclization of the linear intermediate into macrolactam.

II. Leinamycin (lnm) Gene Cluster.

The nucleic acids comprising the leinamycin (lnm) gene cluster are identified in Table 2 and listed in the sequence listing provided herein (SEQ ID NO:1). In particular, Table 1 identifies genes and functions of open reading frames (ORFs) responsible for the biosynthesis of leinamycin, while Table 2 identifies a number of ORFs comprising the leinamycin (lnm) gene cluster, identifies the activity of the catalytic domain encoded by the ORF and provides primers for the amplification and isolation of that orf.

As illustrated in Example 1, the leinamycin (lnm) cluster comprises NRPS modules followed by several PKS modules as well as several resistance and regulatory genes (Table 1).

TABLE 1

Summary of function of open reading frames (ORFs) in the leinamycin biosynthetic gene cluster and flanking regions. Sequence ID Nos refer to amino acid sequences encoded by ORF.

| ORF | # Amino acids | Proposed function | Sequence homologue (Genbank accession no) | SED ID NO |
|---|---|---|---|---|
| −35 | 289 | Probably antibiotic resistance protein | SpcN (AAD50455) | 2 |
| −34 | 502 | Putative FAD-dependent oxygenase | EncM (AAF81732) | 3 |
| −33 | 1237 | Subtilisin-like secreted protease | SAM-P45 (BAA12040) | 4 |
| −32 | 262 | Unknown | | 5 |
| −31 | 401 | Probably NADH dehydrogenase II | (E75456) | 6 |
| −30 | 306 | RNA polymerase ECF-type sigma factor | BH0672 (BAB04391) | 7 |
| −29 | 327 | Probable macrolide 2'-phosphotransferase | MphA (D16251) | 8 |
| −28 | 198 | Probable tetR-family transcriptional regulator | (T37015) | 9 |
| −27 | 538 | Antibiotic efflux protein | ActVA-1 (S18539) | 10 |
| −26 | 300 | Putative hydroxylase | SnoaW (AAF01810) | 11 |
| −25 | 197 | Probable cyanamide hydratase | (P22143) | 12 |
| −24 | 353 | Histidinol-phosphate aminotransferase | (P45358) | 13 |
| −23 | 774 | Putative transcriptional regulator | (T34847) | 14 |
| −22 | 72 | MbtH-like protein | (AAG02368) | 15 |
| −21 | 1105 | Nonribosomal peptide synthetase | (T30289) | 16 |
| −20 | 330 | Probable regulatory protein | SyrP (U88574) | 17 |
| −19 | 335 | Probable regulatory protein | SyrP (U88574) | 18 |
| −18 | 313 | Unknown | | 19 |
| −17 | 341 | Putative fatty acid desaturase | (AAA99932) | 20 |
| −16 | 433 | Diaminopimelate (DAP) decarboxylase | (P00861) | 21 |
| −15 | 794 | Putative peptidase | (NP422131) | 22 |
| −14 | 432 | Antibiotic transport protein | SpcT (AAD50454) | 23 |

TABLE 1-continued

Summary of function of open reading frames (ORFs) in the leinamycin biosynthetic gene cluster and flanking regions. Sequence ID Nos refer to amino acid sequences encoded by ORF.

| ORF | # Amino acids | Proposed function | Sequence homologue (Genbank accession no) | SEQ ID NO |
|---|---|---|---|---|
| −13 | 1134 | Nonribosomal peptide synthetase | (T30289) | 24 |
| −12 | 276 | Conserved, function known | (NP_421851) | 25 |
| −11 | 549 | Nonribosomal peptide synthetase | NosA (AF204805) | 26 |
| −10 | 235 | Thioesterase | (AAC01736) | 27 |
| −9 | 276 | Short-chain dehydrogenase/reductase | LimC (CAB54559) | 28 |
| −8 | 920 | Nonribosomal peptide sythetase | AcmB (T14591) | 29 |
| −7 | 195 | Probable N-carbamoyl-sarcosine amidase | Ta0454 (CAC11596) | 30 |
| −6 | 343 | Hydrogenase expression/formation protein | HypE (P24193) | 31 |
| −5 | 791 | Hydrogenase maturation protein (regulator) | HypF (P30131) | 32 |
| −4 | 447 | Serine hydroxymethyl-transferase (SHMT) | GlyA (O29406) | 33 |
| −3 | 238 | Probable glutamine amidotransferase | (C83609) | 34 |
| −2 | 1745 | Nonribosomal peptide synthetase | BlmVI (AF210249) | 35 |
| −1 | 462 | Nonribosomal peptide synthetase | PvdD (S53999) | 36 |
| lnmA | 399 | Cytochrome P450 hydroxylase | RapN (T30231) | 37 |
| lnmB | 78 | Ferredoxin | (T30230) | 38 |
| lnmC | 115 | Unknown | | 39 |
| lnmD | 438 | Probable 3-oxoadipate enol-lactone hydrolase/4-carboxymuconolactone decarboxylase | PcaL (AAC38246) | 40 |
| lnmE | 307 | Unknown | | 41 |
| lnmF | 265 | Probable enoyl-CoA hydratase | PksH (P40805) | 42 |
| lnmG | 795 | Probable malonyl-CoA acyltransferase/enoyl reductase | FenF (T44805) | 43 |
| lnmH | 274 | Unknown | | 44 |
| lnmI | 4437 | Hybrid nonribosomal peptide synthetase/polyketide synthase | MtaC/MtaB (AF188187) | 45 |
| lnmJ | 7349 | Polyketide synthase/ Tyrosine phenol-lyase/ketoadipate-enol lactone hydrolase | MtaB (AF188287)/ PcaL (AAC38246) | 46 |
| lnmK | 319 | Conserved, function known | TaD (CAB46503) | 47 |
| lnmL | 86 | Acyl carrier protein (ACP, type II) | TaE (CAB46504) | 48 |
| lnmM | 416 | ACP synthase (FabH homolog) | TaF (CAB46505) | 49 |
| lnmN | 267 | Thioesterase (type II) | GrsT (P14686) | 50 |
| lnmO | 227 | Probable transcriptional activator | NtcA (AAC14592) | 51 |
| lnmP | 82 | Peptidyl carrier protein (PCP, type II) | (CAB99152) | 52 |
| lnmQ | 516 | Nonribosomal peptide synthetase (A-domain only, type II) | (AAG02343) | 53 |
| lnmR | 575 | ABC transporter component (ATP hydrolase) | MoaD (T45539) | 54 |
| lnmS | 287 | ABC transporter component (membrane spanning protein) | AgaC (T45530) | 55 |
| lnmT | 321 | ABC transporter component (membrane spanning protein) | AgaB (T45531) | 56 |
| lnmU | 513 | ABC transporter component (periplasmic oligopeptide binding protein) | OphA (S77572) | 57 |
| lnmV | 120 | Unknown | | 58 |
| lnmW | 516 | 4-coumarate:CoA ligase | (T08074) | 59 |
| lnmX | 243 | Conserved, function known | (CAC04222) | 60 |
| lnmY | 474 | Antibiotic efflux protein | Mct (AAD32747) | 61 |
| lnmZ | 400 | Cytochrome P450 hydroxylase | MycG (SS1594) | 62 |
| lnmZ' | 134 | Unknown | | 63 |
| +1 | 216 | Conserved, function known | (C70555) | 64 |
| +2 | 272 | Thioesterase | GrsT(P14686) | 65 |
| +3 | 345 | Conserved, function known | (CAC18692) | 66 |
| +4 | 236 | Probable tetR-family transcriptional regulator | HemR (BAA21913) | 67 |
| +5 | 539 | Antibiotic resistance protein | CarA (AAC32027) | 68 |
| +6 | 322 | Probable hydrolase/lactonase | VgbB (AAC61670) | 69 |
| +7 | 551 | ABC transporter | VarM (BAA96297) | 70 |
| +8 | 469 | Adenosylhomocysteinase | SahH (CAB88907) | 71 |
| +9 | 303 | 5,10-methylenetetrahydrofolate reducatase | MetF (O54253) | 72 |

TABLE 2

ORFs, deduced functions, amino acid sequence homologs, and PCR primers for amplification of individual ORFs identified in the leinamycin biosynthetic gene cluster and its flanking regions

| ORF# | Position | Proposed Function | Protein Homologue | Primers | SEQ ID NO |
|---|---|---|---|---|---|
| -35 | 3489–4358 | Probable antibiotic resistance protein | SpcN (AAD50455) | Fwd: ATGGAGATGTCCGACACC<br>Rev CTACTGGCCGCTGCCCAG | 73<br>74 |
| -34 | 5108–6616 | Putative FAD-dependent oxygenase | EncM (AAF81732) | Fwd: ATGAGCGACTTTTCCCGC<br>Rev: TCAGCGGGACGCAGGCGG | 75<br>76 |
| -33 | 7431–11144 | Subtilisin-like secreted protease | SAM-P45 (BAA 12040) | Fwd: TTGCCCAAGCTTCCCATC<br>Rev: TCAGCGCAGGCCGAAGGC | 77<br>78 |
| -32 | 11141–11812 | Unknown | | Fwd: ATGGCGGACGAACCTGCG<br>Rev: TCATCGTTCCGTCCTCCT | 79<br>80 |
| -31 | 11809–13014 | Probable NADH dehydrogenase II | (E75456) | Fwd: ATGAGCGCACGGCAGGAG<br>Rev: TCACCGTGCCTCCCGGAC | 81<br>82 |
| -30 | 13011–13931 | RNA polymerase ECF- type sigma factor | BH0672 (BAB04391) | Fwd: GTGACCGACCCGACCGCC<br>Rev: TCAGCGCGTCCCGACGTC | 83<br>84 |
| -29 | 14271–15254 | Probable macrolide 2'-pbospbotransferase | MphA (D16251) | Fwd: ATTGGTTGCGAACGAGGGT<br>Rev: TCAGCCGAAGCGGCGGAA | 85<br>86 |
| -28 | 16277–15681 | Probable tetR-family transcriptional regulator | (T37015) | Fwd: ATGGGCCGCGTGTCCCAG<br>Rev: TCAGTCCATGCGCTGCTG | 87<br>88 |
| -27 | 16467–18083 | Antibiotic efflux protein | ActVA-1 (S18539) | Fwd: GTGGCATCGCCACCCACC<br>Rev: TCACTTGTCACCGCCGGT | 89<br>90 |
| -26 | 18480–19382 | Putative hydroxylase | SnoaW (AAF01810) | Fwd: ATGACTGCCGACAACCTG<br>Rev: TCAGCCCAGGTAGAGGTC | 91<br>92 |
| -25 | 20377–19784 | Probable cyanamide hydratase | (P22143) | Fwd: ATGACACTGGACCACCTG<br>Rev: TCAGTCGAGGCTGTTGGT | 93<br>94 |
| -24 | 20662–21723 | Histidinol-phosphate aminotransferase | (P45358) | Fwd: TTGACCACGCTCACGTTC<br>Rev: TCACCGCACGAACGCGTT | 95<br>96 |
| -23 | 21994–24318 | Putative transcriptional regulator | (T34847) | Fwd: ATCCAATTCAGCTCGCGA<br>Rev: TCAGGAGCCCGCGGCCAC | 97<br>98 |
| -22 | 24524–24742 | MbtH-like protein | (AAG02368) | Fwd: ATGAGCGATCGGGACAGT<br>Rev: TCAGCTGCGGCCCGCCTG | 99<br>100 |
| -21 | 24778–28095 | Nonribosomal peptide synthetase | (T30289) | Fwd: ATGCAGACCCAGCTCTCC<br>Rev: TCAGCGGCGCTGCGCGCC | 101<br>102 |
| -20 | 28128–29120 | Probable regulatory protein | SyrP (U88574) | Fwd: ATGACCATTGAGGTGCAC<br>Rev: TCATGCGGGCACCTCGCC | 103<br>104 |
| -19 | 29117–30124 | Probable regulatory protein | SyrP (U88574) | Fwd: ATGACGCTCACCGACCTG<br>Rev: TCATCGGCCGGCCGGCAG | 105<br>106 |
| -18 | 30172–31113 | Unknown | | Fwd: ATGCTGCTGCGCCCCACC<br>Rev: TCAGCCGGCCGGGGCCGA | 107<br>108 |
| -17 | 31140–32165 | Putative fatty acid desaturase | (AAA99932) | Fwd: ATGACGCAGACCGCCCCC<br>Rev: TCACGTCCACGGCGTGCT | 109<br>110 |
| -16 | 32199–33500 | Diaminopimelate (DAP) Decarboxylase | (P00861) | Fwd: ATGAGACCCGACATGAGT<br>Rev: TCACAGACCCTCGGGGAT | 111<br>112 |
| -15 | 35984–33600 | Putative peptidase | (NP-422131) | Fwd: ATGGCCGACACCCGTACC<br>Rev: TCAGAGCACGTATCGGCG | 113<br>114 |
| -14 | 37313–36015 | Antibiotic transport protein | SpcT (AAD50454) | Fwd: GTGGCGCCGCGCACGCCG<br>Rev: TCAGGTCCGTTCCGGTGC | 115<br>116 |
| -13 | 40721–37317 | Nonribosomal peptide synthetase | (T30289) | Fwd: ATGACCGAGACCCTGCCC<br>Rev: TCAGCCCTCCAGCTTCTG | 117<br>118 |
| -12 | 41548–40718 | Conserved, function unknown | (NP_421851) | Fwd: ATGCGATCCGTCCGCACC<br>Rev: TCATCGCTGTCCCTCCGC | 119<br>120 |

TABLE 2-continued

ORFs, deduced functions, amino acid sequence homologs, and PCR primers for amplification of individual ORFs identified in the leinamycin biosynthetic gene cluster and its flanking regions

| ORF# | Position | Proposed Function | Protein Homologue | Primers | SEQ ID NO |
|---|---|---|---|---|---|
| -11 | 41709–43358 | Nonribosomal peptide synthetase | NosA (AF204805) | Fwd: ATGACGGCCGACGATTCG<br>Rev: TCAGGCGGGCGCCTGTTC | 121<br>122 |
| -10 | 43412–44119 | Thioesterase | (AAC01736) | Fwd: ATGTTGAGTGCGGCGGTT<br>Rev: TCATGACGGCGTCCCGGC | 123<br>124 |
| -9 | 44116–44946 | Short-chain dehdrogenase/reductase | LimC (CAB54559) | Fwd: ATGAGCGGACGGCTCACG<br>Rev: TCAACGGGCGCTGTAGCC | 125<br>126 |
| -8 | 44970–47732 | Nonribosomal peptide synthetase | AcmB (T14591) | Fwd: GTGTCGTCCAACTCCCCT<br>Rev: TCAGGCCGTCCTCGCCGC | 127<br>128 |
| -7 | 47820–48407 | Probable N-carbamoyl-sarcosine amidase | Ta0454 (CAC11596) | Fwd: ATGAGCAAGGTCGCGGTC<br>Rev: TCAGGGGGTGCGGAACAC | 129<br>130 |
| -6 | 48545–49576 | Hydrogenase expression/formation protein | HypE (P24193) | Fwd: TTGCCGACGGCCACGACG<br>Rev: CAGCACAGGCGGGGAAG | 131<br>132 |
| -5 | 49599–51974 | Hydrogenase maturation protein (regulator) | HypF (P30131) | Fwd: ATGGCAGAGACCGAGCAG<br>Rev: TCAGCGGCATTCGTTCGT | 133<br>134 |
| -4 | 52006–53349 | Serine hydroxymethyl-transferase (SHMT) | GlyA (O29406) | Fwd: ATCCGGACCGCAGATCTG<br>Rev: TCACCGGGACGCCTCTGT | 135<br>136 |
| -3 | 53346–54062 | Probable glutamine amidotransferase | (C83609) | Fwd: GTGAGCCGGCCGGTCATC<br>Rev: TCAGACGGATGCCGCTGT | 137<br>138 |
| -2 | 54157–59394 | Nonribosomal peptide synthetase | BlmV1 (AF210249) | Fwd: GTGCACACTCACGTCCGT<br>Rev: TCAGCCTTGCTGCTGCAG | 139<br>140 |
| -1 | 59420–60808 | Nonribosomal peptide synthetase | PvdD (S53999) | Fwd: ATGGCCGTGACACTCAAG<br>Rev: TCAACTCACCGCCGGCTG | 141<br>142 |
| InmA | 60948–62147 | Cytochrome P450 hydroxylase | RapN (T30231) | Fwd: ATGTCGGCTACGAGGCGG<br>Rev: TCACCATGCGATCGGCAG | 143<br>144 |
| InmB | 62159–62395 | Ferredoxin | (T30230) | Fwd: ATGGCACGGGAGCAGAAC<br>Rev: TCACGACAGGTCGAGCAC | 145<br>146 |
| InmC | 62682–63029 | Unknown |  | Fwd: ATGAAGTTCGCGATCGTC<br>Rev: TTACTCGGCCACCCACAG | 147<br>148 |
| InmD | 63116–64432 | Probable 3-oxoadipate enol-lactone hydrolase/4-carboxy-muconolactone decarboxylase | PcaL (AAC38246) | Fwd: ATGACGGACGGCGCGATA<br>Rev: TCACCGTGCGGCGCCGCT | 149<br>150 |
| InmE | 64500–65423 | Unknown |  | Fwd: ATGACCGACGCGGCGAGC<br>Rev: TCAGAACCAGGCGGGCGC | 151<br>152 |
| InmF | 65441–66238 | Probable enoyl-CoA hydratase | PksH (P40805) | Fwd: GTGACGGCCATCGGCCCG<br>Rev: TCAGGGCCGCGGCTTCTC | 153<br>154 |
| InmG | 66268–68655 | Probable malonyl-CoA acyltransferase/enoyl reductase | FenF (144805) | Fwd: ATGGTGGCACTGGTTTTC<br>Rev: TCAGCGGCGGGCGAGGAC | 155<br>156 |
| InmH | 68725–69549 | Unknown |  | Fwd: ATGACCACCCTGACCTTC<br>Rev: CTAGCGGGCGTCCGGCAC | 157<br>158 |
| InmI | 69681–82994 | Hybrid nonribosomal peptide synthetase/polyketide synthase | MtaC/MtaB (AF188187) | Fwd: ATGACCACCCTGACCTTC<br>Rev: TCACCACTTCCGTCCTTC | 159<br>160 |
| InmJ | 82991–105040 | Hybrid polyketide synthase/tyrosine phenol-lyase ketoadipate-enol lactone hydrolase | MtaB (AF188287)/<br>PeaL (AAC38246) | Fwd: GTGAACGTGCCCTCCGCA<br>Rev: TCATGCCGGGTGCTCCTC | 161<br>162 |

TABLE 2-continued

ORFs, deduced functions, amino acid sequence homologs, and PCR primers for amplification of individual ORFs identified in the leinamycin biosynthetic gene cluster and its flanking regions

| ORF# | Position | Proposed Function | Protein Homologue | Primers | SEQ ID NO |
|---|---|---|---|---|---|
| lnmK | 105037–105996 | Conserved, function unknown | TaD (CAB46503) | Fwd: ATGACCATCACCTCGTCG<br>Rev: TCATGCTTCCCCCTTCGG | 163<br>164 |
| lnmL | 105993–106253 | Acyl carrier protein (ACP, type II) | TaE (CAB46504) | Fwd: ATGACCCAGGCACCACTG<br>Rev: TCATCGCGGGGCTCCGCT | 165<br>166 |
| lnmM | 106250–107500 | ACP synthase (FabH homolog) | TaF (CAB46505) | Fws: ATGACCGCGACCGGTGCC<br>Rev: TCAGCGCCACGCGTACTG | 167<br>168 |
| lnmN | 107557–108360 | Thioesterase (type II) | GrsT | Fwd: GTGTACGGCTCTCGGACG<br>Rev: TCACGTGGCAACTTTATG | 169<br>170 |
| lnmO | 108395–109078 | Probable transcriptional activator | NtcA (AAC14592) | Fwd: ATGAACCTGCTGGATGTC<br>Rev: TCAGACGCATCGGCTCTC | 171<br>172 |
| lnmP | 109122–109370 | Peptidyl carrier protein (PCP, type II) | (CAB99152) | Fwd: ATGTGGGACCACAAGTTC<br>Rev: TCATCGGCCGGCTCCGTC | 173<br>174 |
| lnmQ | 109367–110917 | Nonribosomal peptide synthetase (A-domain) | (AAG02343) | Fwd: ATGAGCGGCGCCAAGCTG<br>Rev: TCAGGACGCCGGGGCGAG | 175<br>176 |
| lnmR | 112700–110973 | ABC transporter component | MoaD (T45539) | Fwd: TTGAGCGCAGTCTTCGAC<br>Rev: TCAGACCCCGTCGACTGC | 177<br>178 |
| lnmS | 113560–112697 | ABC transporter component | AgaC (T45530) | Fwd: ATGACGGCCCCGACGCCG<br>Rev: TCAAGGCACGAACCTCGC | 1791<br>80 |
| lnmT | 114522–113557 | ABC transporter component | AgaB (T45531) | Fwd: GTGACGTCCGCCGTCCGG<br>Rev: TCATGTCGCCGTCCTCAT | 181<br>182 |
| lnmU | 116060–114519 | ABC transporter component | OphA (S77572) | Fwd: ATGTCACGGGTCAACGGC<br>Rev: TCACGCGGACCTGGCCCG | 183<br>184 |
| lnmV | 116494–116132 | Unknown | | Fwd: ATGAGCACCGACAGGAG<br>Rev. TCAGGCCCACCAGTCGCG | 185<br>186 |
| lnmW | 118041–116491 | 4-coumarate: CoA ligase | (T08074) | Fwd: ATGACGGAACGGACGTTC<br>Rev: TCATGACGGGGCTCCTGT | 187<br>188 |
| lnmX | 118780–118049 | Conserved, function unknown | (CAC04222) | Fwd: ATGGCCGACACACTCCTC<br>Rev: TCAACCCACTATCTGGAA | 189<br>190 |
| lnmY | 120239–118815 | Antibiotic efflux protein | Mct (AAD32747) | Fwd: ATGACCGTCAGGACCGAC<br>Rev: TCAGGCGGCGGCGTCGGT | 191<br>192 |
| lnmZ | 121638–120436 | Cytochrome P450 hydroxylase | MycG (S51594) | Fwd: GTGAGCACCGAAGTGGAA<br>Rev: TCACCACTCGACGTGCAT | 193<br>194 |
| lnmZ' | 121757–122161 | Unknown | | Fwd: ATGACTCAGATGCGGATT<br>Rev: CTAGGCAGCCCCGTCGGT | 195<br>196 |
| +1 | 122832–122182 | Conserve, function unknown | (C70555) | Fwd: ATGGCGCCCGGCTCCGGC<br>Rev: TCAGCCCTTCCCGGCCGC | 197<br>198 |
| +2 | 123664–122846 | Thioesterase | GrsT (P14686) | Fwd: GTGGACCGAGAGGGGAAC<br>Rev: TCAGAACGTCCGCTCGGC | 199<br>200 |
| +3 | 123898–124935 | Conserved, function unknown | (CC18692) | Fwd: ATGACCGGCACGCTCGTG<br>Rev: TCACCAACTGGTCCTGCT | 201<br>202 |
| +4 | 125516–124806 | Probable tetR-family transcriptional regulator | HemR (BAA21913) | Fwd: ATGCCACCGCCTCCCCGA<br>Rev: TCAGATCAGGGCGCGCCG | 203<br>204 |
| +5 | 125637–127256 | Antibiotic resistance protein | CarA (AAC32027) | Fwd: ATGCCTACGCAGATCAGC<br>Rev: TCAGACCCGGACGGCCTG | 205<br>206 |
| +6 | 127231–128199 | Probable hydrolase/lactonase | VgbB (AAC61670) | Fwd: ATGCACCACAGGCCGTCC<br>Rev: CTAGAGCTCCATGCGCAG | 207<br>208 |
| +7 | 129971–128316 | ABC transporter | VarM (BAA96297) | Fwd: ATGACCACCCACCCGAAC<br>Rev: TCACGGTGTCACCGCTTC | 209<br>210 |

TABLE 2-continued

ORFs, deduced functions, amino acid sequence homologs, and PCR primers for amplification of individual ORFs identified in the leinamycin biosynthetic gene cluster and its flanking regions

| ORF# | Position | Proposed Function | Protein Homologue | Primers | SEQ ID NO |
|---|---|---|---|---|---|
| +8 | 131727– 130318 | Adenosylhomocysteina se | SahH (CAB88907) | Fwd: ATGCCCTCGCAGCCGCCC<br>Rev: TCAGTAGCGGTAGTGGTC | 211<br>212 |
| +9 | 132616– 131705 | 5,10-methylenetetra-hydrofolate reductase | MetF (O54253) | Fwd: TTGAGCACGCTGCGCGAC<br>Rev: TCAGCGGGCGGCTGCGAG | 213<br>214 |

*Function assignment was based on Gapped-BLAST and PSI-BLAST (Ref.1) analysis. Term "Probable" indicates that the biochemical function of at least one significant homologue has been confirmed; term "Putative" indicates that the function of homologues is solely deduced from sequence similarity.
_ORFs translated on the complementary strand of DNA are underlined.

This invention also provides the cloning and sequence of a 4'-phophopantetheinyl transferase (PPTase) from *S. atroolivaceus*. The PPTase sequence from *S. atroolivaceus* is named as "lnm" in the amino acid pileup analysis illustrated in FIG. 5. The rest are PPTases from other peptide and/or polyketide producing microorganisms. The Lnm PPTase described herein facilitates engineered biosynthesis of the leinamycin NRPS-PKS genes for generation of chemical structural diversity.

Using the sequence information provided herein (e.g. primer sequences and PPTase sequence) the PPTase nucleic acids can be routinely isolated according to standard methods (e.g. PCR amplification).

III. Expression of Leinamycin (lnm) Gene Clusters, Modules, and Enzymatic Domains.

As indicated above, in one embodiment this invention provides novel NRPS and PKS genes for the efficient recombinant production of both novel and known polyketides, peptides, and polyketide/polypeptide hybrids by expressing them in vivo. In other embodiments, such syntheses are carried out in vitro. Even in vitro syntheses, however, typically utilize recombinantly expressed PKSs, NRPSs, or enzymatic domains thereof. Thus, it is frequently desirable to express protein components of the PKSs or NRPs described above.

Typically expression of the protein components of the pathway and/or of the products of the NRPS/PKS pathway is accomplished by placing the subject PKS or NRPS nucleic acid(s) in an expression vector, and transfecting a cell with the vector such that the cell expressed the desired product(s).

A Isolation/Preparation of Nucleic Acids.

In one embodiment, this invention provides nucleic acids for the recombinant expression of a leinamycin. Such nucleic acids include isolated gene cluster(s) comprising open reading frames encoding polypeptides sufficient to direct the assembly of a leinamycin.

In other embodiments of this invention, modified leinamycins (e.g. leinamycin analogs), novel polyketides, polypeptides, and combinations thereof (polyketide/polypeptide hybrids) are created by modifying PKSs and/or NRPSs so as to introduce variations into known polymers synthesized by the enzymes. Such variation may be introduced by design, for example to modify a known molecule in a specific way, e.g. by replacing a single monomeric unit within a polymer with another, thereby creating a derivative molecule of predicted structure. Alternatively, variations can be made randomly, for example by making a library of molecular variants of a known polymer by systematically or haphazardly replacing one or more modules or enzymatic domains in a known PKS or NRPS with a collection of alternative modules or domains. Production of alternative/modified PKSs, NRPSs and hybrid systems is described below.

Using the primer and sequence information provided herein, one of ordinary skill in the art can routinely isolate/clone the leinamycin PKS and/or NRPS modules and/or enzymatic domains (ORFs) described herein. For example, the PCR primers (SEQ ID NOs 73–214) provided in Table 2, above, can be used to amplify any of the orfs identified therein. Moreover, using the sequence information for the leinamycin (lnm) gene cluster provided herein (see, e.g., SEQ ID NO:1), the design of other primers suitable of the amplification of individual ORFs, combinations of ORFs, genes, etc. is routine.

Typically such amplifications will utilize the DNA of an organism containing the requisite genes (e.g. *Streptomyces atroolivaceus*) as a template. Typical amplification conditions include a PCR mixture consisting of 5 ng of *S. atroolivaceus* genomic or plasmid DNA as template, 25 pmoles of each primers, 25 µM dNTP, 5% DMSO, 2 units of Taq polymerase, 1× buffer, with or without 20% glycerol in a final volume of 50 µL. PCR is carried out (e.g. on a Gene Amp PCR System 2400 (Perkin-Elmer/ABI)) with a cycling scheme as follows: initial denaturing at 94° C. for 5 min, 24–36 cycles of 45 sec at 94° C., 1 min at 60° C., 2 min at 72° C., followed by additional 7 min at 72° C. One of skill will appreciate that optimization of such a protocol, e.g. to improve yield, etc. is routine (see e.g., U.S. Pat. No. 4,683,202; Innis (1990) *PCR Protocols A Guide to a Methods and Applications*. Academic Press Inc. San Diego, Calif., etc.). In addition, primer may be designed to introduce restriction sites and so facilitate cloning of the amplified sequence into a vector.

Using the information provided herein other approaches to cloning the desired sequences will be apparent to those of skill in the art. For example, the PKS or NRPS modules or enzymatic domains of interest can be obtained from an organism that expresses the same, using recombinant methods, such as by screening cDNA or genomic libraries, derived from cells expressing the gene, or by deriving the gene from a vector known to include the same. The gene can then be isolated and combined with other desired NRPS and/or PKS modules or domains, using standard techniques.

If the gene in question is already present in a suitable expression vector, it can be combined in situ, with, e.g., other PKS and/or NRPS subunits, as desired. The gene of interest can also be produced synthetically, rather than cloned. The nucleotide sequence can be designed with the appropriate codons for the particular amino acid sequence desired. In general, one will select preferred codons for the intended host in which the sequence will be expressed. The complete sequence can be assembled from overlapping oligonucleotides prepared by standard methods and assembled into a complete coding sequence (see, e.g., Edge (1981) *Nature* 292:756; Nambair et al. (1984) *Science* 223: 1299; Jay et al. (1984) *J. Biol. Chem.* 259:6311). In addition, it is noted that custom gene synthesis is commercially available (see, e.g. Operon Technologies, Alameda, Calif.).

Examples of such techniques and instructions sufficient to direct persons of skill through many cloning exercises are found in Berger and Kimmel (1989) *Guide to Molecular Cloning Techniques, Methods in Enzymology* 152 Academic Press, Inc., San Diego, Calif. (Berger); Sambrook et al. (1989) *Molecular Cloning—A Laboratory Manual* (2nd ed.) Vol. 1–3, Cold Spring Harbor Laboratory, Cold Spring Harbor Press, NY; Ausubel (19 1994) *Current Protocols in Molecular Biology*, Current Protocols, a joint venture between Greene Publishing Associates, Inc. and John Wiley & Sons, Inc., U.S. Pat. No. 5,017,478; and European Patent No. 0,246,864.

B) Expression Vectors and Host Cells.

A wide variety of expression vectors and host cells are suitable for the synthesis of leinamycin or leinamycin analogues, or the expression of polypeptides comprising the leinamycin biosynthetic pathway.

The choice of vector depends on the sequence(s) that are to be expressed. Any transducible cloning vector can be used as a cloning vector for the nucleic acid constructs of this invention. However, where large clusters are to be expressed, phagemids, cosmids, P1s, YACs, BACs, PACs, HACs or similar cloning vectors can be used for cloning the nucleotide sequences into the host cell. Phagemids, cosmids, and BACs, for example, are advantageous vectors due to the ability to insert and stably propagate therein larger fragments of DNA than in M13 phage and lambda phage, respectively. Phagemids which will find use in this method generally include hybrids between plasmids and filamentous phage cloning vehicles. Cosmids which will find use in this method generally include lambda phage-based vectors into which cos sites have been inserted. Recipient pool cloning vectors can be any suitable plasmid. The cloning vectros into which pools of mutants are inserted may be identical or may be constructed to harbor and express different genetic markers (see, e.g., Sambrook et al., supra). The utility of employing such vectors having different marker genes may be exploited to facilitate a determination of successful transduction.

In certain embodiments of this invention, vectors are used to introduce PKS, NRPS, or NRPS/PKS genes or gene clusters into host (e.g. *Streptomyces*) cells. Numerous vectors for use in particular host cells are well known to those of skill in the art. For example described in Malpartida and Hopwood, (1984) *Nature*, 309:462–464; Kao et al., (1994), *Science*, 265: 509–512; and Hopwood et al., (1987) *Methods Enzymol.*, 153:116–166 all describe vectors for use in various *Streptomyces* hosts.

In a certain embodiment, *Streptomyces* vectors are used that include sequences that allow their introduction and maintenance in *E. coli*. Such *Streptomyces/E. coli* shuttle vectors have been described (see, for example, Vara et al., (1989) *J. Bacteriol.*, 171:5872–5881; Guilfoile & Hutchinson (1991) *Proc. Natl. Acad. Sci. USA*, 88: 8553–8557.)

*S. atroolivaceus* is sensitive to thiostrepton (Thi) and apramycin (Apr). Thus, in one preferred embodiment the pGM60 (Muth et al. (1989) *Mol. Gen. Genet.*, 219: 341–348), vector carrying the Thi$^R$ marker, and pKC1139 (Bierman et al. (1992) *Gene*, 116: 43–49) vector, carrying the Apr$^R$ marker, are particularly well suited for expression of lnm nucleic acids. Introduction of plasmid DNA into *S. atroolivaceus* by either polyethyleneglycol (PEG)-mediated transformation of protoplasts (Hopwood et al. (1985) *Genetic manipulation of Streptomyces: a laboratory manual.*, John Innes Foundation: Norwich, UK) or by conjugation from *E. coli* S17 (Bierman et al. (1992) *Gene*, 116: 43–49) was successful, demonstrating the feasibility of manipulating Lnm biosynthesis in *S. atroolivaceus* in vivo.

The gene sequences, or fragments thereof, which collectively encode an lnm gene cluster, one or more ORFs, one or more lnm modules, or one or more lnm enzymatic domains of this invention, can be inserted into expression vectors, using methods known to those of skill in the art. Preferred expression vectors will include control sequences operably linked to the desired NRPS and/or PKS coding sequence or fragment thereof. Suitable expression systems for use with the present invention include systems that function in eukaryotic and prokaryotic host cells. However, as explained above, prokaryotic systems are preferred, and in particular, systems compatible with *Streptomyces* spp. are of particular interest. Control elements for use in such systems include promoters, optionally containing operator sequences, and ribosome binding sites. Particularly useful promoters include control sequences derived from PKS and/or NRPS gene clusters, such as one or more act promoters. However, other bacterial promoters, such as those derived from sugar metabolizing enzymes, such as galactose, lactose (lac) and maltose, will also find use in the present constructs. Additional examples include promoter sequences derived from biosynthetic enzymes such as tryptophan (trp), the beta-lactamase (bla) promoter system, bacteriophage lambda PL, and T5. In addition, synthetic promoters, such as the tac promoter (U.S. Pat. No. 4,551,433), which do not occur in nature also function in bacterial host cells. In *Streptomyces*, numerous promoters have been described including constitutive promoters, such as ermE and tcmG (Shen and Hutchinson, (1994) *J. Biol. Chem.* 269: 30726–30733), as well as controllable promoters such as actI and actIII (Pleper et al., (1995) *Nature*, 378: 263–266; Pieper et al., (1995) *J. Am. Chem. Soc.*, 117: 11373–11374; and Wiesmann et al., (1995) *Chem. & Biol.* 2: 583–589).

Other regulatory sequences may also be desirable which allow for regulation of expression of the PKS replacement sequences relative to the growth of the host cell. Regulatory sequences are known to those of skill in the art, and examples include those which cause the expression of a gene to be turned on or off in response to a chemical or physical stimulus, including the presence of a regulatory compound. Other types of regulatory elements may also be present in the vector, fore example, enhancer sequences.

Selectable markers can also be included in the recombinant expression vectors. A variety of markers are know which are useful in selecting for transformed cell lines and generally comprise a gene whose expression confers a selectable phenotype on transformed cells when the cells are grown in an appropriate selective medium. Such markers include, for example, genes that confer antibiotic resistance or sensitivity to the plasmid. Alternatively, several polyketides are naturally colored and this characteristic provides a built-in marker for selecting cells successfully transformed by the present constructs.

The various lnm PKS and/or NRPS clusters or subunits of interest can be cloned into one or more recombinant vectors as individual cassettes, with separate control elements, or under the control of, e.g., a single promoter. The PKS and/or NRPS subunits can include flanking restriction sites to allow for the easy deletion and insertion of other PKS subunits so that hybrid PKSs can be generated. The design of such unique restriction sites is known to those of skill in the art and can be accomplished using the techniques described above, such as site-directed mutagenesis and PCR.

Methods of cloning and expressing large nucleic acids such as gene clusters, including PKS- or NRPS-encoding gene clusters, in cells including *Streptomyces* are well known to those of skill in the art (see, e.g., Stutzman-Engwall and Hutchinson (1989) *Proc. Natl. Acad. Sci. USA*, 86: 3135–3139; Motamedi and Hutchinson (1987) *Proc. Natl. Acad. Sci. USA*, 84: 4445–4449; Grim et al. (1994) *Gene*, 151: 1–10; Kao et al. (1994) *Science*, 265: 509–512; and Hopwood et al. (1987) *Meth. Enzymol.*, 153: 116–166). In some examples, nucleic acid sequences of well over 100 kb have been introduced into cells, including prokaryotic cells, using vector-based methods (see, for example, Osoegawa et al., (1998) *Genomics*, 52: 1–8; Woon et al., (1998) *Genomics*, 50: 306–316; Huang et al., (1996) *Nucl. Acids Res.*, 24: 4202–4209).

Host cells for the recombinant production of the leinamycin, leinamycin analogues, leinamycin shunt metabolites, lnm modules, orfs, or catalytic domains, and the like can be derived from any organism with the capability of harboring a recombinant PKS, NRPS or PKS/NRPS gene cluster. Thus, the host cells of the present invention can be derived from either prokaryotic or eukaryotic organisms. However, preferred host cells are those constructed from the actinomycetes, a class of mycelial bacteria that are abundant producers of a number of polyketides and peptides. A particularly preferred genus for use with the present system is *Streptomyces*. Thus, for example, *S. verticillus S. ambofaciens, S. avermitilis, S. atroolivaceus, S. azureus, S. cinnamonensis, S. coelicolor, S. curacoi, S. erythraeus, S. fradiae, S. galilaeus, S. glaucescens, S. hygroscopicus, S. lividans, S. parvulus, S. peucetius, S. rimosus, S. roseofulvus, S. thermotolerans, S. violaceoruber*, among others, will provide convenient host cells for the subject invention, with *S. coelicolor* being preferred (see, e.g., Hopwood, D. A. and Sherman, D. H. *Ann. Rev. Geneet.* (1990) 24:37–66; O'Hagan, D. *The Polyketide Metabolites (Ellis Horwood Limited*, 1991), for a description of various polyketide-producing organisms and their natural products).

Two of the common problems associated with heterologous gene expression in *E. coli* are (1) the formation of inclusion bodies, which requires additional steps of solubilization and refolding and often leads to inactive enzymes, and (2) the inadequate posttranslational processing of the resulting enzymes. These problems can be circumvented by expressing genes of *Streptomyces* origin in *Streptomyces* as indicated above. In preferred embodiments, cloning is performed using *E. coli-Streptomyces* shuttle vectors (e.g., pWHM3, pWHM601, pANT1200, pANT1201, pGM60, pKC1139). Using shuttle vectors, most of the subclonings can be easily carried out in *E. coli*. As indicated above, particularly preferred vectors include pGM60, pKC1139. If controlled expression of the target gene is desired, pMR5 (McDaniel et al. (1993) *Science*, 262: 1546–1550) is a good choice since it carries the actI and actIII promoter pair, the transcription of which is under the control of the actII-ORF4 transcriptional regulator. This vector has been used for the expression of various PKS (McDaniel et al. (1999) *Proc. Natl. Acad. Sci., USA*, 96: 1846–1851; Pieper et al. (1995) *Nature*, 378: 263–266) genes, including the Blm NRPS and PKS genes very recently by us, in *S. coelicolor* and *S. lividans*.

In addition, a new family of 4'-phosphopantetheine transferases has been recently identified, which catalyze the posttranslational modification by the covalent attachment of the 4'-phosphopantetheine moiety of CoA to a conserved serine residue of either the PCP domain of NRPS or the ACP domain of PKS (Gehring et al. (1997) *Chem. Biol.*, 4: 17–24; Lambalot et al. (1996) *Chem. Biol.*, 3: 923–936; Walsh et al. (1997) *Curr. Opinion Chem. Biol.* 1: 309–315). It is now possible to overproduce functional holo-NRPS or PKS either in vivo by co-expression of the NRPS or PKS gene and a 4'-phosphopantetheine transferase gene (Du and Shen (1999) *Chem. Biol.*, 6: 507–517; Cox et al. (1997) *FEBS Lett.*, 405: 267–272; Ku et al. (1997) *Chem. Biol.*, 4: 203–207) or in vitro by phosphopantetheinylation of an apo-ACP or apo-PCP with CoA in the presence of a 4'-phosphopantetheine transferase (Du and Shen (1999) *Chem. Biol.*, 6: 507–517; Cox et al. (1997) *FEBS Lett.*, 405: 267–272). Both in vivo and in vitro methods have been established in our laboratory (Du and Shen (1999) *Chem. Biol.*, 6: 507–517) and can be applied to the production of functional Lnm NRPS and PKS enzymes, should the need of posttranslational modification arise.

In certain embodiments this invention may make use of genetically engineered cells that either lack PKS and/or NRPS genes or have their naturally occurring PKS and/or NRPS genes substantially deleted. These host cells can be transformed with recombinant vectors, encoding a variety of PKS and/or NRPS gene clusters, for the production of active polyketides. The invention provides for the production of significant quantities of product, e.g. a leinamycin, at an appropriate stage of the growth cycle. The leinamycin, leinamycin analogues, or other polyketide, peptide, or hybrid polyketide/peptide metabolites so produced can be used as therapeutic agents, to treat a number of disorders, depending on the type of metabolites in question.

The vectors and host cells described above can be used to express various protein components of the polyketide and/or polypeptide synthetic modules for subsequent isolation and/or to provide a biological synthesis of one or more desired biomolecules (e.g. leinamycin, leinamycin analogues, and the like). Where leinamycin, and/or leinamycin analogues, and/or one or more proteins of the leinamycin (lnm) cluster are expressed (e.g. overexpressed) for subsequent isolation and/or characterization, the proteins are expressed in any prokaryotic or eukaryotic cell suitable for protein expression. In one preferred embodiment, the proteins are expressed in *E. coli*. Overexpression of leinamycin in *E. coli* is described in Example 1.

In certain embodiments, a eukaryotic host cell is preferred (e.g. where certain glycosylation patterns are desired). Suitable eukaryotic host cells are well known to those of skill in the art. Such eukaryotic cells include, but are not limited to yeast cells, insect cells, plant cells, fungal cells, and various mammalian cells (e.g. COS, CHO HeLa cells lines and various myeloma cell lines)

C) Protein/Polyketide Recovery.

Polypeptide and/or polyketide recovery is accomplished according to standard methods well known to those of skill in the art. Thus, for example where lnm cluster proteins are to be expressed and isolated, the proteins can be expressed with a convenient tag to facilitate isolation (e.g. a $His_6$) tag.

Other standard protein purification techniques are suitable and well known to those of skill in the art (see, e.g., Quadri et al. (1998) *Biochemistry* 37: 1585–1595; Nakano et al. (1992) *Mol. Gen. Genet.* 232: 313–321, etc.).

Similarly where components (e.g. modules and/or enzymatic domains) of the leinamycin cluster are used to express various biomolecules (e.g. polyketides, polypeptides, etc.) the desired product and/or shunt metabolite(s) are isolated according to standard methods well know to those of skill in the art (see, e.g., Carreras and Khosla (1998) *Biochemistry*, 37: 2084–2088; Deutscher (1990) *Methods in Enzymology Volume* 182: *Guide to Protein Purification*, M. Deutscher, ed., and the like). Hara et al. (1989) *J. Antibiot.* 42: 1768–1774 discloses and effective culture system that, with minor modifications was used to express leinamycin (see Example 1). Purification of expressed leinamycin is also described in Example 1.

D) Optimized Expression System

Four methods are typically used for introduction of plasmid DNA into *Streptomyces* species: PEG-mediated protoplast transformation, electroporation, conjugation, and phage infection. Standard protocols are available in the *Streptomyces* laboratory manual (Hopwood et al. (1985) *Genetic manipulation of Streptomyces: a laboratory manual*., John Innes Foundation: Norwich, UK), and several different transformation systems have been described for various *Streptomyces* species (Liu and Shen (2000) *Antimicrob. Agents Chemother.*, 44; 382–392; Lichenstein et al. (1990) *Gene*, 88: 81–86; Zang et al. (1997) *J. Ferment. Bioeng.*, 83: 217–221; Matsushima and Baltz (1985) *J. Bacteriol.*, 162: 180–185; Garcia-Dominguez et al. (1987) *App. Environ. Microbiol.*, 53: 1376–1381; Aidoo et al. (1990) *J. Gen. Microbiol.*, 136: 657–662; Illing et al. (1989) *J. Gen. Microbiol.*, 135: 2289–2297).

Example 1, describes a transfection system optimized for *S. atroolivaceus*. A conjugation approach was pursued, with surprising success. Spores ($1 \times 10^9$) are heat-shocked or 20 min at 42° C. instead of 10 min at 50° C. followed by incubation at 30° C. for up to 6 hours. The germination of spores can be monitored by microscopic checks every 30 min from 4 hours after heat-shock. *E. coli* S17-1 (bearing the desired construct) culture is freshly prepared and conjugation is conducted on modified ISP-4 medium. After incubation, e.g. at 28° C. for 5 days, apparent positive ex-conjugates are identified. We calculated conjugation/integration efficiency for a non-self-replicating construct pYC12 as approximately $1.8 \times 10^{-8}$, and the conjugation efficiency for self-replicating construct was $5 \times 10^{-7}$.

IV. Synthesis of Leinamycin and Leinamycin Analogues.

In one embodiment this invention provides methods of synthesizing leinamycins and recombinantly synthesized leinamycins. As indicated above, this is generally accomplished by providing an organism (e.g. a bacterial cell) containing sufficient components of the leinamycin gene cluster to direct synthesis of a complete leinamycin and/or leinamycin analogue.

In one embodiment, the entire leinamycin cluster, or a fragment thereof (e.g. designed to introduce a modification into the cluster through homologous recombination) is cloned into a *Streptomyces* strain (e.g., *S. lividans*, *S. atroolivaceus*, or *S. coelicolor*). Kao et al.(1994) *Science*, 265: 509–512, have cloned the 30 kb DEBS genes from *Sacc. erythmea* into *S. coelicolor* and produced 6-deoxyerythronolide B in *S. coelicolor* and these methods can be used construct an expression plasmid for heterologous expression of the leinamycin cluster. This method involves the transfer of DNA between a temperature-sensitive plasmid and a shuttle vector by means of a homologous double recombination event in *E. coli* (Sssio et al., (2000) *Nature Biotechnol.* 18: 343–345).

In one preferred embodiment, the two ends spanning the leinamycin cluster or fragment thereof, or recombinant construct, are cloned into a temperature-sensitive plasmid that is chloramphenicol resistant ($CM^R$) such as pCK6. *Streptomyces* DNA is then rescued from a donor into the temperature-sensitive recipient by co-transforming *E. coli* with the $Cm^R$ recipient plasmid and the apramycin resistant ($Ap^R$) pKC505 donor cosmid that contains the desired construct, followed by chloramphenicol and apramycin selection at 30° C. Colonies harboring both plasmids ($Cm^R$, $Ap^R$) will be shifted to 44° C. on chloramphenicol and apramycin plates and only those cointegrates formed by a single recombination event between the two plasmids are viable. Surviving colonies are then propagated at 30° C. on $Cm^R$ plates to select for recombinant plasmids formed by the resolution of cointegrates through a second recombinant event. The desired construct is cloned into the $Cm^R$ temperature-sensitive plasmid and is ready to be moved into any expression plasmid by a similar means of homologous recombinant event.

Another system illustrated in Example 1, exploits the fact that *S. atroolivaceus* grows very well at 30° C.; and doesn't grow at temperature beyond 35° C. In addition, it is highly sensitive to both apromycin (Am) and thiostrepton (Thio). Thus, *E. coli-Streptomyces* shuttle vectors pOJ260 (suicide vector, $Am^R$) and pKC1139 (self-replicating vector, $Am^R$) can be used to make the desired Imp or Imp-modification constructs.

The methods and constructs of this invention can be used to alter expression of endogenous leinamycin. Using the lnm gene cluster information provided herein, one of skill in the art may regulate the synthesis of endogenous leinamycin. In particular, the expression of various ORFs comprising the lnm gene cluster may be increased or decreased to alter leinamycin synthesis levels.

Methods of altering the expression of endogenous genes are well known to those of skill in the art. Typically such methods involve altering or replacing all or a portion o the regulatory sequences controlling expression of the particular gene that is to be regulated. In a preferred embodiment, the regulatory sequences (e.g., the native promoter) upstream of one or more of the lnm ORFs are altered.

This is typically accomplished by the use of homologous recombination to introduce a heterologous nucleic acid into the native regulatory sequences. To down-regulate expression of one or more lnm ORFs, simple mutations that either alter the reading frame or disrupt the promoter are suitable. To upregulate expression of the lnm ORF(s) the native promoter(s) can be substituted with heterologous promoter(s) that induce higher than normal levels of transcription. In a particularly preferred embodiment, nucleic acid sequences comprising the structural gene in question or upstream sequences are utilized for targeting heterologous recombination constructs. The use of homologous recombination to alter expression of endogenous genes is described in detail in U.S. Pat. No. 5,272,071, WO 91/09955, WO 93/09222, WO 96/29411, WO 95/31560, and WO 91/12650.

In addition, or alternatively, constructs can be introduced that express particular ORF at higher levels than in the wildtype organism. For example, leinamycin production yield improvement by engineering leinamycin biosynthesis has been demonstrated using lnmG as an example. LnmG is a di-domain protein with amino acid sequence homology to acyltransferase (AT) the 1st domain) and enoyl reductase (ER) (the 2nd domain). Inactivation of lnmG yields an *S. atroolivaceus* mutant strain whose ability to produce leinamycin is completely abolished. This result unambiguously establishes that lnmG, and thereby the cloned gene cluster, encodes leinamycin production.

Figure 6:
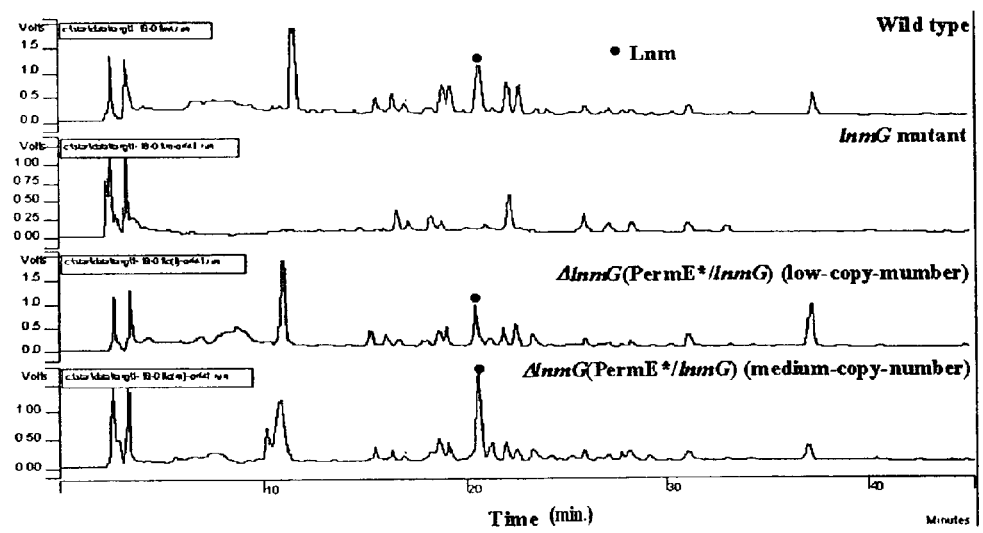
FIG. 6 illustrates how altering lnmG expression alters leinamycin expression. Inactivation of lnmG yields an *S. atroolivaceus* mutant strain whose ability to produce leinamycin is completely abolished. Introduction of an lnmG overexpression plasmid into the *S. atroolivaceus* lnmG mutant not only restores its ability to produce leinamycin but also results in an overproduction of leinamycin in comparison with the wild type *S. atroolivaceus* strain. Thus, *S. atroolivaceus* lnmG mutant transformed with a low-copy-number (10) plasmid in which the expression of lnmG is under the control of the ermE* promoter produces similar level of leinamycin as the wild type *S. atroolivaceus* strain. *S. atroolivaceus* lnmG mutant transformed with a medium-copy-number (300) plasmid in which the expression of lnmG is under the control of the ermE* promoter produces 3–5 fold more leinamycin than the wild type *S. atroolivaceus* strain.

Introduction of an lnmG overexpression plasmid into the *S. atroolivaceus* lnmG mutant not only restores its ability to produce leinamycin but also result in an overproduction of leinamycin in comparison with the *S. atroolivaceus* strain. This as shown in FIG. 6, *S. atroolivaceus* lnmG mutant transformed with a low-copy number (10) plasmid in which the expression of lnmG is under the control of the ermE promoter produces similar level of leinamycin as the wild type *S. atroolivaceus* strain. *S. atroolivaceus* lnmG mutant transformed with a medium-copy-number (300) plasmid in which the expression of lnmG is under the control of the ermE promoter produces 3–5 fold more leinamycin than the wild type *S. atroolivaceus* strain.

In one certain embodiment, this invention provides methods of synthesizing modified leinamycins or leinamycin analogs. Typically, in such embodiments, the leinamycin analogs are synthesized either by introducing specific perturbations into individual NRPS and/or PKS enzymatic domains or modules, or by reprogramming the linear order in which the NRPS or PKS enzymatic domains and/or modules appear in the leinamycin gene cluster. The former will lead to leinamycin analogs with targeted modifications at the leinamycin backbone and the latter will allow incorporation of other extension units in variable sequence into the biosynthesis of leinamycin.

In preferred embodiments modification o the lnm gene cluster to yield leinamycin analogues is accomplished by one of two different approaches. In one approach, the lnm enzymatic domains and/or modules are altered in a directed manner (i.e. they are changed in a preselected way), while in another approach, random/haphazard alterations are introduced into the lnm cluster (SEQ ID NO 1) and the resulting products are screened to identify those with desired properties.

A) Synthesis of Leinamycin Analogs by Specific Engineering of the lnm Genes.

The lnm genes can be re-engineered by means of specific mutations or by reprogramming the linear order of the NRPS or PKS enzymatic domains or modules. In this approach, a wild-type lnm allele (ORF) is replaced (ore recombined) with a mutant construct containing various lnm ORFs in a different order. These mutants are introduced into and expressed in an appropriate host (e.g., *Streptomyces* or in a heterologous host). Since both NRPSs (Stachelhaus et al. (1995) *Science*, 269: 69–72) and PKSs (Donadio et al. (1993) *Proc. Natl. Acad. Sci. USA*, 90: 7119–7123, Donadio et al. (1995) *J. Am., Chem, Soc.*, 117: 9105–9106, Cortes et al. (1995) *Science*, 268: 1487–1489) have shown considerable tolerance to reprogramming, it is expected that these modifications of the lnm cluster will result in the production of leinamycin analogs with predicted structural alterations.

Figure 7:
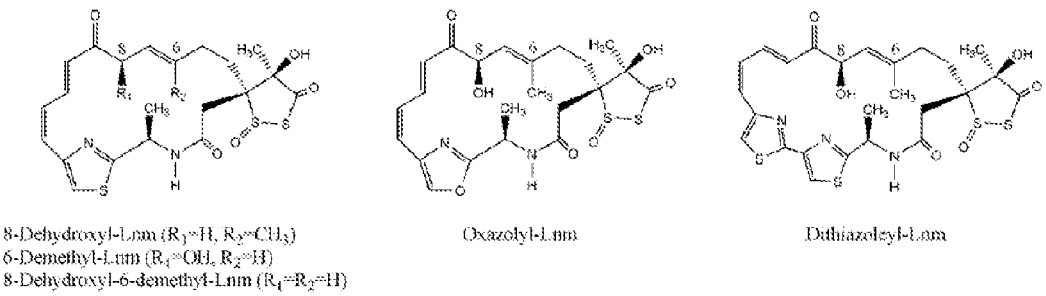
FIG. 7 illustrates examples of novel Lnm analogs that can be prepared by manipulating the Lnm NRPS and PKS genes.

Using this approach, rational manipulations of genes governing Lnm biosynthesis allow preparation of novel Lnm analogs that are extremely difficult to prepare by chemical modifications or that present a formidable task by total synthesis. Examples of such analogs include 8-dehydroxyl-Lnm, 6-demethyl-Lnm, and 8-dehydroxyl-6-demethyl-Lnm (FIG. 7), which can be generated inactivating the genes encoding the C-8 hydroxylases, such as lnmA (SEQ ID NO 37), lnmB (SEQ ID NO 38), or lnmZ (SEQ ID NO 62), and the MT domain of PKS-4 of lnmJ encoding the C-6 methyl transferase individually or both, respectively (FIG. 4, FIG. 7).

Figure 8:
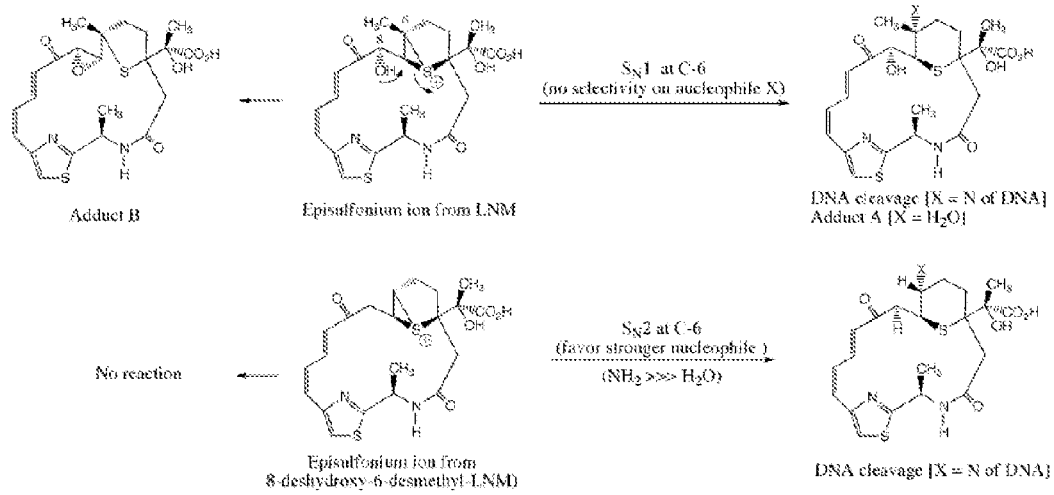
FIG. 8 illustrates nucleophilic attack of the episulfonium ion by —$NH_2$ or $H_2O$ via $S_N1$ or $S_N2$ mechanism.

The stability of Lnm under aqueous condition depends on the pH: $t_{1/2}>20$ hr at pH 6, $t_{1/2}=8$ hr at pH 7, and $t_{1/2}<1$ hr at pH 8 (Asai et al. (1997) *Bioorg. Med. Chem.* 5: 723–729). In the presence of a thiol, Lnm exhibits an even shorter $t_{1/2}$ and is inactivated by degradation to form two major adducts A and B (FIG. 8). Removal of the 8-hydroxyl group as in 8-dehydroxyl-Lnm should therefore eliminate the formation of adduct B, effectively enhancing the concentration of the active form of episulfonium ion. Adduct A results from nucleophilic attack of the episulfonium ion by $H_2O$, instead of DNA—leading to alkylative DNA cleavage. Since the electrophilic center (C-6) of the episulfonium ion is a 3° carbon in Lnm, the nucleophilic attack of the latter by $H_2O$ or the —$NH_2$ group of DNA likely proceeds via a $S_N1$ mechanism. Consequently, little discrimination between the two nucleophiles are observed (Asai et al. (1997) *Bioorg. Med. Chem.* 5: 723–729). In contrast, 6-dimethyl-Lnm will generate an episulfonium with a 2° carbon as the electrophilic center. The latter intermediate should be more stable and is likely to alkylate DNA via a $S_N2$ mechanism. Consequently, being a much stronger nucleophile than $H_2O$, the —$NH_2$ group of DNA should be selectively alkylated, leading to DNA cleavage, and $H_2O$ may be not a stronger enough nucleophile to attack the episulfonium to form the inactive adduct A (at least competed unfavorably in the presence of DNA). Finally 8-dehydroxyl-6-demethyl-Lnm should exhibit both an improved stability and selectivity towards DNA cleavage, serving as a good drug candidate (FIG. 8).

Other preferred embodiments contemplate the synthesis of Lnm analogs with an oxazole or bithiazole moiety—oxazolyl-Lnm or dithiazolyl-Lnm, respectively (FIG. 7). The former could be prepared by replacing the cysteine-specific A domain at NRPS-2 with a serine-specific A domain (Shen et al. (1999) *Bioorg. Chem.,* 27: 155–171), and the latter could be effected by replacing the NRPS-2 module with the bithiazole-forming NRPS modules from the bleomycin gene cluster (see PCT/US00/00445). Since it is known that oxazole and thiazole play an important role in drug-DNA recognition (Li et al. (1996) *Science* 274: 1188–1193; Roy et al. (1999) *Nat. Prod. Rep.,* 16: 249–263), it is reasonable to assume that these novel oxazole- or bithiazole-containing Lnm analogs may exhibit improved efficacy as anticancer agents. These five examples are only representatives of the types of Lnm analogs that could be prepared by rational engineering of the Lnm NRPS/PKS genes, with the choice being influenced by considerations of mechanism of action for Lnm. We envisage that various other permutations can be introduced into Lnm by genetic manipulation of the Lnm NRPS and PKS genes.

Engineering of both NRPS and PKS by either domain or module swapping has been very successful for making novel peptides (Stachelhaus et al. (1995) *Science,* 269: 69–72; Belshaw et al. (1999) *Science,* 284: 486–489; Stachelhaus et al. (1999) *Chem. Biol.* 6: 493–505; de Ferra et al. (1997) *J. Biol. Chem.,* 272: 25304–25309; Elsner et al. (1997) *J. Biol. Chem.,* 272: 4814–4819; Schneider et al. (1998) *Mol. Gen. Genet.,* 257: 308–318; Stachelhaus and Marahiel (1996) *Biochem. Pharmacol.,* 52: 177–186) and polyketides (Donadio et al. (1993) *Proc. Natl. Acad. Sci., USA,* 90: 7119–7123; Cortes et al. (1995) *Science,* 268: 1487–1489; Kao et al. (1994) *Science,* 265: 509–512; Kao et al. (1994) *J. Am. Chem. Soc.,* 116: 11612–11613; Kao et al. (1995) *J. Am. Chem. Soc.,* 117: 9105–9106; McDaniel et al. (1997) *J. Am. Chem. Soc.,* 119: 4309–4310; Pieper et al. (1997) *Biochem-* istry, 36: 1846–1851; Bedford et al. (1996) *Chem. Biol.*, 3: 826–831; Oliynyk et al. (1996) *Chem. Biol.*, 3: 833–839; McDaniel et al. (1999) *Proc. Natl. Acad. Sci., USA*, 96: 1846–1851; Jacobsen et al. (1997) *Science*, 277: 367–369; Gokhale et al. (1999) *Science*, 284: 482–485; Ruan et al. (1997) *J. Bacteriol.*, 179: 6416–6425; Stassi et al. (1998) *Proc. Natl. Acad. Sci., USA*, 95: 7305–7309) with the desired structural alterations. Domain or modules boundaries for both NRPS and PKS are well defined, although the effectiveness of individual domain or module swamping experiment is preferably empirically determined.

In certain preferred embodiments, macrolactam products are isolated and subjected to mass spectrum and 1-D and 2-D NMR analyses to determine whether inactivation of lnmA, lnmB, lnmZ, and/or the MT domain of PKS-3 in lnmJ, respectively, has resulted in the production of 8-deoxyl-LNM, or 6-demethyl-Lnm, respectively. Similar strategy is used to carry out the double inactivation of the hydroxylase and methyl transferase genes for the production of 8-dehydroxyl-6-demethyl-Lnm, as well as the desired domain or module replacement of the Lnm NRPS-2 to construct *S. atroolivaceus* recombinant strains producing oxazolyl-Lnm and dithiazoly-Lnm.

Although in vivo manipulation of Lnm biosynthesis in *S. atroolivaceus* has been demonstrated as feasible herein, in certain embodiments, methods to clone the entire lnm gene cluster into e.g., *S. lividans* or *S. coelicolor*—either by the newly developed *E. coli-Streptomyces* artificial chromosome (Sosio et al. (2000) *Nature Biotechnol.* 18: 343–345) or by the multi-plasmid approach (Tang et al. (2000) *Science*, 87: 640–642; Xue et al. (1999) *Proc. Natl. Acad. Sci. USA*, 96: 11740–11745) (up to three compatible *Streptomyces* vectors) are available and can be used.

Figure 9A:
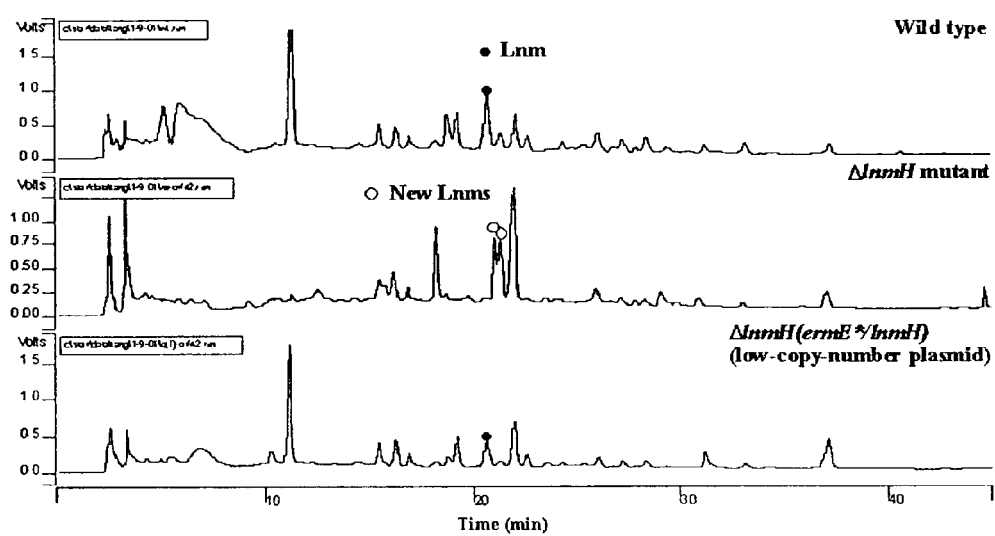
FIG. 9A: LnmH is a protein of unknown function on the basis of amino acid sequence analysis. Inactivation of LnmH yields an *S. atroolivaceus* mutant that no longer produces leinamycin but accumulates at least two new leinamycin metabolites upon HPLC analysis. Complementation of the LnmH mutant by overexpression of LnmH under the ermE* promoter in a low-copy-number plasmid restores the leinamycin production to the mutant strain with the same metabolite profile as the wild type *S. atroolivaceus* strain.
Figure 9B:
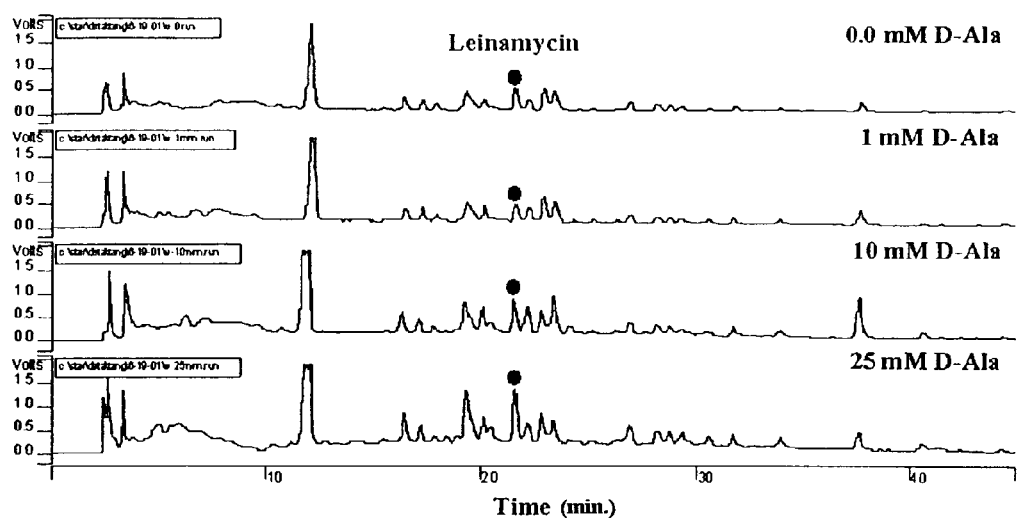
In FIG. 9B, leinamycin productions were compared in fermentation media supplemented with various concentrations of D-alanine. Leinamycin production can be improved by 3–5 folds upon addition of 25 mM D-analine.
Figure 9C:
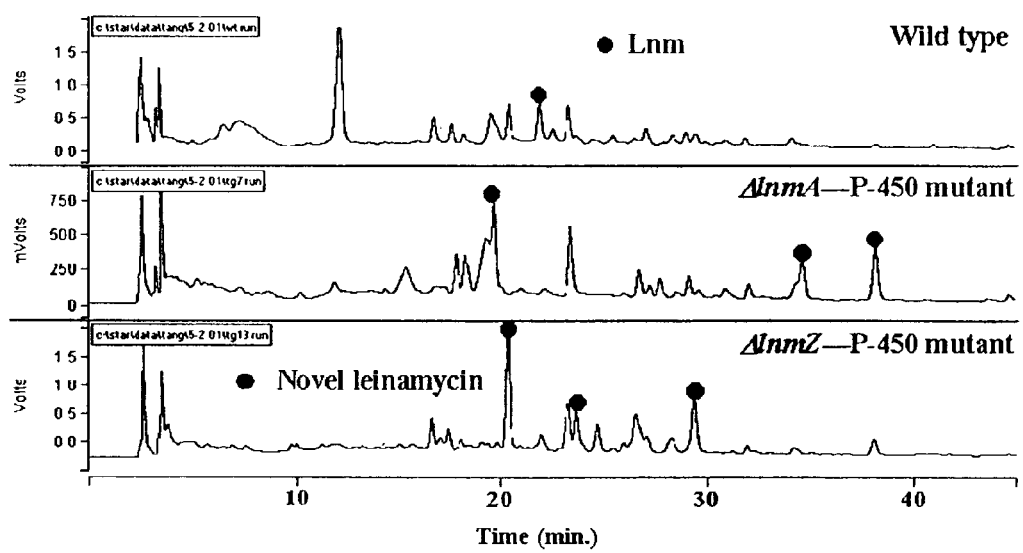

Production of novel leinamycins by engineering leinamycin biosynthesis has been demonstrated with lnmH as an example. LnmH is a protein of unknown function on the basis of amino acid sequence analysis. Inactivation of lnmH yields an *S. atroolivaceus* mutant that no longer produces leinamycin but accumulates at least two new leinamycin metabolites upon HPLC analysis (see FIGS. 9). The production of these new metabolites results exclusively from the inactivation of lnmH (SEQ ID NO 44). Complementation of the lnmH mutant by overexpression of lnmH under the ermE* promoter in a low-copy-number plasmid restores the leinamycin production to the mutant strain with the same metabolite profile as the wild type *S. atroolivaceus* strain.

B) Synthesis of Leinamycin Analogs by "Random" Modification of lnm Genes.

Leinamycin analogs can also be synthesized by randomly/haphazardly altering genes in the lnm cluster expressing the products of the randomly modified megasynthetase and then screening the products for the desired activity. Methods of "randomly" altering lnm cluster genes are described below.

V. Generation of Other Synthetic Systems.

In addition to the production of leinamycin or modified leinamycins, the leinamycin gene cluster or elements thereof can be used by themselves or in combination with NRPS and/or PKS modules and/or enzymatic domains of other PKS and/or NRPS systems to produce a wide variety of compounds including, but not limited to various polyketides, polypeptides, polyketide/polypeptide hybrids, various oxazoles and thiazoles, various sugars, various methylated polypeptides/polyketides, and the like. As with the production of modified leinamycins described above, such compounds can be produced, in vivo or in vitro, by catalytic biosynthesis using large, modular PKSs, NRPSs, and hybrid PKS/NRPS systems. The megasynthetases directing such syntheses can be rationally designed e.g. by predetermined alteration/modification of polyketide and/or polypeptide and/or hybrid PKS/NRPS pathways. Alternatively, large combinatorial libraries of cells harboring various megasynthetases can be produced by the random modification of particular pathways and then selected for the production of a molecule or molecules of interest. It will be appreciated that, in certain embodiments, such libraries of megasynthetases/modified pathways, can be used to generate large, complex combinatorial libraries of compounds which themselves can be screened for a desired activity.

A) Directed Modification of Biomolecules.

Elements (e.g. open reading frames) of the leinamycin biosynthetic gene cluster and/or variants thereof can be used in a wide variety of "directed" biosynthetic processes (i.e. where the process is designed to modify and/or synthesize one or more particular preselected metabolite(s)). Polypeptides encoded by particular open reading frames or combinations of open reading frames can be utilized to perform particular chemical modifications of biological molecules.

Thus, for example, open reading frames encoding a polypeptide synthetase can be used to chemically modify an amino acid by coupling it to another amino acid. One of skill in the art, utilizing the information provided here, can perform literally countless chemical modifications and/or syntheses using either "native" leinamycin biosynthesis metabolites as the substrate molecule, or other molecules capable of acting as substrates for the particular enzymes in question. Other substrates can be identified by routine screening. Methods of screening enzymes for specific activity against particular substrates are well known to those of skill in the art.

The biosyntheses can be performed in vivo, e.g. by providing a host cell comprising the desired leinamycin gene cluster open reading frame(s) and/or in vitro, e.g., by providing the polypeptides encoded by the leinamycin gene cluster orfs and the appropriate substrates and/or cofactors.

B) Directed Engineering of Novel Synthetic Pathways.

In numerous embodiments of this invention, novel polyketides, polypeptides, and combinations thereof are created by modifying known PKSs or NRPSs so as to introduce variations into known polymers synthesized by the enzymes. Such variations may be introduced by design, for example to modify a known molecule in a specific way, e.g. by replacing a single monomeric unit within a polymer with another, thereby creating a derivative molecule of predicted structure. Such variations can also be made by adding one or more modules to a known PKS or NRPS, or by removing one or more module from a known PKS or NRPS. Such novel PKSs or NRPSs can readily be made using a variety of techniques, including recombinant methods and in vitro synthetic methods.

Using any of these methods, it is possible to introduce PKS domains into a NRPS, or vice versa, thereby creating novel molecules including both peptide and polyketide structural domains. For example, a PKS enzyme producing a known polyketide can be modified so as to include an additional module that adds a peptide moiety into the polyketide. Novel molecules synthesized using these methods can be screened, using standard methods, for any activity of interest, such as antibiotic activity, effects on the cell cycle, effects on the cytoskeleton, etc.

Novel polyketides, polypeptides, or combinations thereof can also be made by creating novel PKSs or NRPSs de novo, using recombinant or in vitro synthetic methods. Such novel arrangements of domains can be designed, i.e. to create a specific polymer. In addition to creating novel PKSs or NRPSs by combining modules, the methods of this invention can also be used to make novel modules that can add new monomeric units to a growing polypeptide or polyketide chain. Because the identity of each module, and, consequently, the identity of the monomer added by the module, is determined by the identity and number of the functional domains comprising the module, it is possible to produce novel monomeric units by creating novel combinations of functional domains within a module. Such novel modules can be created by design, for example to make a specific module that will add a specific monomer to a polyketide or polypeptide, or can be created by the random association of domains so as to produce libraries of novel modules. Such novel modules can be made using recombinant or in vitro synthetic means.

Mutations can be made to the native NRPS and/or PKS subunit sequences and such mutants used in place of the native sequence, so long as the mutants are able to function with other PKS and/or PKS subunits to collectively catalyze the synthesis of an identifiable polyketide and/or polypeptide. Such mutations can be made to the native sequences using conventional techniques such as by preparing synthetic oligonucleotides including the mutations and inserting the mutated sequence into the gene encoding a NRPS and/or PKS subunit using restriction endonuclease digestion. (see, e.g., Kunkel, (1985) *Proc. Natl. Acad. Sci. USA* 82: 448; Geisselsoder et al. (1987) *BioTechniques* 5: 786). Alternatively, the mutations can be effected using a mismatched primer (generally 10–20 nucleotides in length) that hybridizes to the native nucleotide sequence, at a temperature below the melting temperature of the mismatched duplex. The primer can be made specific by keeping primer length and base composition within relatively narrow limits and by keeping the mutant base centrally located (Zoller and Smith (1983) *Meth, Enzymol.* 100: 468). Primer extension is effected using DNA polymerase, the product cloned and clones containing the mutated DNA, derived by segregation of the primer extended strand, selected. Selection can be accomplished using the mutant primer as a hybridization probe. The technique is also applicable for generating multiple point mutations (see, e.g., Dalbie-McFarland et al. (1982) *Proc. Natl. Acad. Sci USA* 79: 6409). PCR mutagenesis will also find use for effecting the desired mutations.

C) Random Modification of PKS/NRPS Pathways.

In another embodiment, variations can be made randomly, for example by making a library of molecular variants of a known polymer by randomly mutating one or more PKS or NRPS modules and/or enzymatic domains or by randomly replacing one or more modules or enzymatic domains in a known PKS or NRPS with a collection of alternative modules and/or enzymatic domains.

The PKS and/or NRPS modules can be combined into a single multi-modular enzyme, thereby dramatically increasing the number of possible combinations obtained using these methods. These combinations can be made using standard recombinant or nucleic acid amplification methods, for example by shuffling nucleic acid sequences encoding various modules or enzymatic domains to create novel arrangements of the sequences, analogous to DNA shuffling methods described in Crameri et al., (1998) *Nature* 391: 288–291, and in U.S. Pat. Nos. 5,605,793 and in 5,837,458. In addition, novel combinations can be made in vitro, for example by combinatorial synthetic methods. Novel polymers, or polymer libraries, can be screened for any specific activity using standard methods.

Random mutagenesis of the nucleotide sequences obtained as described above can be accomplished by several different techniques known in the art, such as by altering sequences within restriction endonuclease sites, inserting an oligonucleotide linker randomly into a plasmid, by irradiation with X-rays or ultraviolet light, by incorporating incorrect nucleotides during in vitro DNA synthesis, by error-prone PCR mutagenesis, by preparing synthetic mutants or by damaging plasmid DNA in vitro with chemicals. Chemical mutagens include, for example, sodium bisulfite, nitrous acid, hydroxylamine, agents which damage or remove bases thereby preventing normal base-pairing such as hydrazine or formic acid, analogues of nucleotide precursors such as nitrosoguanidine, 5-bromouracil, 2-aminopurine, or acridine intercalating agents such as proflavine, acriflavine, quinacrine, and the like. Generally, plasmid DNA or DNA fragments are treated with chemicals, transformed into *E. coli* and propagated as a pool or library of mutant plasmids.

Large populations of random enzyme variants can be constructed in vivo using "recombination-enhanced mutagenesis." This method employs two or more pools of, for example, $10^6$ mutants each of the wild-type encoding nucleotide sequence that are generated using any convenient mutagenesis technique, described more fully above, and then inserted into cloning vectors.

D) Incorporation and/or Modification of Non-lnm Cluster Elements.

In either the directed or random approaches, nucleic acid encoding novel combinations of modules and/or enzymatic are introduced into a cell. In one embodiment, nucleic acids encoding one or more PKS or NRPS domains are introduced into a cell so as to replace one or more domains of an endogenous PKS or NRPS within a chromosome of the cell. Endogenous gene replacement can be accomplished using standard methods, such as homologous recombination. Nucleic acids encoding an entire PKS, NRPS, or combination thereof can also be introduced into a cell so as to enable the cell to produce the novel enzyme, and, consequently, synthesize the novel polymer. In a preferred embodiment, such nucleic acids are introduced into the cell optionally along with a number of additional genes, together called a 'gene cluster,' that influence the expression of the genes, survival of the expressing cells, etc. In a particularly preferred embodiment, such cells do not have any other PKS- or NRPS-encoding genes or gene clusters, thereby allowing the straightforward isolation of the polymer synthesized by the genes introduced into the cell.

Furthermore, the recombinant vector(s) can include genes from a single PKS and/or NRPS gene cluster, or may comprise hybrid replacement PKS gene clusters with, e.g., a gene for one cluster replaced by the corresponding gene from another gene cluster. For example, it has been found that ACPs are readily interchangeable among different synthases without an effect on product structure. Furthermore, a given KR can recognize and reduce polyketide chains of different chain lengths. Accordingly, these genes are freely interchangeable in the constructs described herein. Thus, the replacement clusters of the present invention can be derived from any combination of PKS and/or NRPS gene sets that ultimately function to produce an identifiable polyketide and/or peptide.

Examples of hybrid replacement clusters include, but are not limited to, clusters with genes derived from two or more of the act gene cluster, the whiE gene cluster, frenolicin (fren), granaticin (gra), tetracenomycin (tcm), 6-methylsalicylic acid (6-msas), oxytetracycline (otc), tetracycline (tet), erythromycin (ery), griseusin (gris), nanamycin, medermycin, daunroubicin, tylosin, carbomycin, spiramycin, avermectin, monensin, nonactin, curamycin, rifamycin and candicidin synthase gene clusters, among others. (For a discussion of various PKSs, see, e.g., Hopwood and Sherman (199) Ann. Rev. Genet. 24: 37–66; O'Hagan (1991) The Polyketide Metabolites, Ellis Horwood Limited.

A number of hybrid gene clusters have been constructed, having components derived from the act, fren, tcm, gris and gra gene clusters (see, e.g., U.S. Pat. No. 5,712,146). Other hybrid gene clusters, as described above, can easily be produced and screened using the disclosure herein, for the production of identifiable polyketides, polypeptides or polyketide/polypeptide hybrids.

Host cells (e.g. *Streptomyces*) can be transformed with one or more vectors, collectively encoding a functional PKS/NRPS set (e.g. a leinamycin or leinamycin analog), or a cocktail comprising a random assortment of PKS and/or NRPS genes, modules, active sites, or portions thereof. The vector(s) can include native or hybrid combinations of PKS and/or NRPS subunits or cocktail components, or mutants thereof. As explained above, the gene cluster need not correspond to the complete native gene cluster but need only encode the necessary PKS and/or NRPS components to catalyze the production of the desired product. For example, in *Streptomyces* aromatic PKSs, carbon chain assembly requires the products of three open reading frames (ORFs). ORF1 encodes a ketosynthase (KS) and an acyltransferase (AT) active site (KS/AT); ORF2 encodes a chain length-determining factor (CLF), a protein similar to the ORF1 product but lacking the KS and AT motifs; and ORF3 encodes a discrete acyl carrier protein (ACP). Some gene clusters also code for a ketoreductase (KR) and a cyclase, involved in cyclization of the nascent polyketide backbone. However, it has been found that only the KS/AT, CLF, and ACP, need be present in order to produce an identifiable polyketide. Thus, in the case of aromatic PKSs derived from *Streptomyces*, these three genes, without the other components of the native clusters, can be included in one or more recombinant vectors, to constitute a "minimal" replacement PKS gene cluster.

E) Variation of Starter and Extender Units.

In addition to varying the PKS and/or NRPS modules and/or domains, variations in the products produced by various PKS/NRPS systems can be obtained by varying the starter units and/or the extender units. Thus, for example, a considerable degree of variability exists for starter units, e.g., acetyl CoA, malonyl CoA, propionyl CoA, acetate, butyrate, isobutyrate and the like. In addition, naturally occurring PKSs and/or NRPSs have shown some tolerance for varying extender units.

F) Screening of Products.

Particularly where large combinatorial libraries are synthesized, e.g. using one or more modules and/or enzymatic domains of the lnm gene cluster it will often be desired to screen the resulting compound(s) for the desired activity. Methods of screening compounds (e.g. polypeptides, polyketides, sugars, thiazoles, etc.) for various activities of interest (e.g. cytotoxicity, antimicrobial activity, particular chemical activities, etc.) are well known to those of skill in the art.

Where large numbers of compounds are produced, it is often desired to rapidly screen such compounds using "high throughput systems" (HTS). High throughput assays systems are well known to those of skill in the art and many such systems are commercially available. (see, e.g., Zymark Corp., Hopkinton, Mass.; Air Technical Industries, Mentor, Ohio; Beckman Instruments, Inc. Fullerton, Calif.; Precision Systems, Inc., Natick, Mass., etc.). These systems typically automate entire procedures including all sample and reagent pipetting, liquid dispensing, timed incubations, and final readings of the microplate(s) in detector(s) appropriate for the assay. These configurable systems provide high throughput and rapid start up as well as a high degree of flexibility and customization. The manufacturers of such systems typically provide detailed protocols for the various high throughput screens.

VI. In Vitro Syntheses.

In additional embodiments of this invention, leinamycins and other polyketides and/or polypeptides are synthesized and/or modified in vitro. Individual enzymatic domains or modules can be used in vitro to modify a unit and/or to add a single monomeric unit to a growing polyketide or polypeptide chain. In one approach a metasynthetase providing all the desired synthetic activities recombinantly expressed and then provided, the appropriate substrates and buffer system e.g. in a bioreactor, to direct the synthesis of the desired product. In another approach, various PKSs and/or NRPSs are provided in different solutions and the growing polymer chains can be sequentially introduced into the plurality of solutions, each containing a single (or several) PKS or NRPS modules. In still another embodiment, the PKS and/or NRPS modules or enzymatic domains are provided attached to a solid support and a fluid containing the growing macromolecule is passed over the surface whereby the PKSs or NRPSs are able to react with the target substrate.

In one preferred embodiment, a combinatorial library of polyketides or polypeptides, or combinations thereof, is created by using automated means to facilitate the sequential introduction of a multitude of polymeric chains, each attached to a solid support, to a collection of solutions, each containing a single PKS or NRPS module. These automated means can be used to systematically vary the sequence by which each polymeric chain is introduced into the various solutions, thereby creating a combinatorial library. Numerous methods are well known in the art to create combinatorial libraries of molecules by the sequential addition of monomeric units, for example as described in WO 97/02358.

VII. Kits.

In still another embodiment, this invention provides kits for practice of the methods described herein. In one preferred embodiment, the kits comprise one or more containers containing nucleic acids encoding one or more of the lnm gene cluster ORFs and/or one or more of the lnm PKS or NRPS modules or enzymatic domains. Certain kits may comprise vectors encoding the lnm orfs and/or cells containing such vectors. The kits may optionally include any reagents and/or apparatus to facilitate practice of the assays described herein. Such reagents include, but are not limited to buffers, labels, labeled antibodies, bioreactors, cells, etc.

In addition, the kits may include instructional materials containing directions (i.e., protocols) for the practice of the methods of this invention. Preferred instructional materials provide protocols utilizing the kit contents for creating or modifying lnm module or ORF and/or for synthesizing or modifying a molecule using one or more lnm modules and/or enzymatic domains. While the instructional materials typically comprise written or printed materials they are not limited to such. Any medium capable of storing such instructions and communicating them to an end user is contemplated by this invention. Such media include, but are not limited to electronic storage media (e.g., magnetic discs, tapes, cartridges, chips), optical media (e.g., CD ROM), and the like. Such media may include addresses to internet sites that provide such instructional materials.

VIII. Methods of Utilizing LnmG and Discrete Acyltransferases from Related Type I PKS and Type I PKS/NRPS Systems.

The majority of type I PKSs characterized to date include modules minimally containing three domains, β-ketoacyl synthase (KS), acyl transferase (AT), and acyl carrier protein (ACP), that select, activate, and catalyze a Claisen condensation between the extender unit and the growing polyketide chain from the proceeding module, generating a β-ketoacyl-S-ACP intermediate. Optional domains are found between AT and ACP that carry out the variable set of reductive modifications of the β-keto group before the next round of chain extension.

In modular PKS systems, selection of the extender unit for each module, as well as the starter unit in many cases, is carried out by the AT domain (Reeves et al, *Biochemistry* 2001, 40, 15464–15470). Extender and starter molecules include (e.g., malonyl CoA, alkyl malonyl CoA (including methyl malonyl CoA, ethyl malonyl CoA and propionyl malonyl CoA), acyl malonyl CoA, hydroxy malonyl CoA and alkoxy malonyl CoA (e.g., methoxy malonyl CoA). An AT domain catalyzes the transacylation of the monomer unit from CoA to the phosphopantetheine arm of the acyl carrier protein (ACP) in the same module. AT domains generally possess a stringent specificity for a single acyl-CoA substrate in their natural context, although some ATs can incorporate at least two different monomers with similar efficiencies. Amino acid sequence alignments between methylmalonyl-CoA (mmCoA)-specific and malonyl-CoA (mCoA)-specific AT domains cluster into two groups according to the specificity of the domain (Schwecke et al (1995) *Proc. Natl. Acad. Sci. USA* 92, 7839–7843), Kakavas et al (1997) *J. Bacteriol.* 179, 7515–7522. and Wu et al (2000) *Gene* 251, 81–90). At least three divergent sequence motifs for AT domains have been identified on the basis of such alignments and comparison to the *Escherichia coli* malonyl-CoA:ACP transacylase (FabD) crystal structure (Haydock, et al. (1995) *FEBS Lett.* 374, 246–248, and Serre et al. (1995) *J. Biol. Chem.* 270, 12961–12964 and Ikeda et al., *Proc. Natl. Acad. Sci. USA*, 96, 9509–9514).

Despite the identification of regions within modular ATs that correlate with specificity, the most popular method of engineering substrate utilization in PKSs has been via the exchange of the entire ~300–350-amino acid AT domain of one module with a homologous AT domain specific for a different starter or extender unit, obtained from another module, usually of a heterologous PKS. A number of successful AT replacements with modular PKSs have been reported, in most case producing a new polyketide with the predicted structural change (Kuhtoss et al. (1996) *Gene* 183, 231–236, Oliynyk et al. (1996) *Chem. Biol.* 3, 833–839, Liu et al. (1997) *J. Am. Chem. Soc.* 119, 10553–10554, and Ruan et al. (1997) *J. Bacteriol.* 179, 6416–6425, Stassi et al. (1998) *Proc. Natl. Acad. Sci. USA* 95, 7305–7309 and McDaniel et al. (1999) *Proc. Natl. Acad. Sci. USA* 96, 1846–1851)(e.g., malonyl CoA, methyl malonyl CoA, ethyl malonyl CoA, acyl malonyl CoA, hydroxy malonyl CoA and methoxy malonyl CoA). McDaniel et al. constructed a combinatorial library of polyketides using 6-ethoxyerythronolide B synthase (DEBS), the PKS that produces the macrolide ring of erythromycin. This was accomplished by substituting the modular ATs and beta-carbon processing domains of DEBS with counterparts from rapamycin PKS (RAPS) that encode alternative substrate specificities and beta-carbon reduction/dehydration activities. However, occasionally AT replacements are only marginally successful or entirely unsuccessful, leading to only very small amounts of the desired compound or no product at all, for unknown reasons (Ruan et al. (1997) *J. Bacteriol.* 179, 6416–6425).

If it is assumed that the genetic engineering of the PKS results in little or no predicted product, there are at least two possible reasons for such failures. Either the foreign AT domain causes the PKS complex to fold incorrectly and lose a necessary activity, or the replacement leads to a modified polyketide chain that is not recognized as a substrate by a subsequent ("downstream") PKS activity. In the former case, success might be achieved by changing AT domain specificity in a manner that minimized perturbation to the tertiary structure of the module, e.g., mutagenesis of a limited number of amino acids. To do so, however, requires an understanding of the complex rules for proper PKS folding and the structural features involved in substrate recognition.

The inventors' characterization of the leinamycin biosynthesis gene cluster has revealed that the leinamycin (LNM) PKS from *Streptomyces* atroolivaceus S-140 is composed of six modules, all of which contain the core KS and ACP domains as well as the variable set of optional domains but completely lack a cognate AT domain indicative of a type I PKS. Instead, the inventors identified that a discrete, interactive AT protein, acting in trans, loads the malonyl CoA extender unit onto the ACPs of all six PKS modules. This finding provides new insights into PKS structure and mechanism and suggests an alternative model for a type I PKS in which the KS and ACP domains of each module could minimally constitute the core structure. This structure further suggests a novel way in which PKS and PKS/NRPS systems may be advantageously manipulated without the disadvantages of the engineering approaches described above.

Rare exceptions to the general type I PKS model have also been observed in bacterial PKS systems which may possess separate AT enzymes encoded elsewhere within their genomes to act in trans to load the appropriate acyl groups (Duitman et al., 1999; Paitan et al., 1999; Huang et al., 2001. Zhu et al. 2002, Gene 298: 79–89). A PKS containing such putative "super ATs" is the only partly described pks cluster (Albertini et al. (1995) *Microbiology* 141, 299–309) in the genome of *Bacillus subtilis*. Its gene products consist of a large number of PKS modules without AT domains and, encoded at the upstream end of the cluster, three isolated ATs. The secondary metabolite generated by these proteins is not known. Another related system is the mupirocin PKS from *Pseudomonas fluorescens* recently submitted to GenBank (accession no. AF318063). This cluster contains a single gene with two AT domains. A small number of further PKS modules lacking AT domains are known from the albicidin (Huang et al, (2001) *Microbiology* 147, 631–642) and TA biosynthesis gene clusters (Paitan et al. (1999) *J. Mol. Bio.* 286, 465–474). Both systems have only been analyzed in part thus far, but it is very likely that they also contain discrete AT genes.

Also, AT homologs are completely absent in the PKS/NRPS responsible for pederin production in the bacterial symbiont of *Paederus* beetles. (Peil, J. (2002) *Proc. Natl. Acad. Sci.*, 99: 14002–14007.) The pederin system's alignment with other known type I PKSs revealed that a continuous ≈300-aa region of each AT domain, including the active-site GHS motif, are deleted in the type I PKSs PedF and PedG, with no other domain replacing them. PedC (SEQ ID NO 251) and PedD (SEQ ID NO 255), reside upstream of pedF and appear to be discrete AT enzymes.

Data supportive of the trans loading of the Lnm PKS by LnmG, a discrete transacylase (AT), is set forth in Example 2. Embodiments of the present invention therefore include the use of the discrete AT, LnmG (SEQ ID NO 257) or a catalytically active fragment thereof, in a wide variety of biosynthetic processes wherein the acyltransferase activity of LnmG is utilized to load extender molecules onto ACP domains of PKS modules. Furthermore, the present invention is also directed to LnmG-like molecules, homologs of LnmG, or fragments thereof which can be utilized in similar fashion to LnmG in the following methods.

Processes utilizing discrete LnmG include "directed" approaches (i.e., where the process is designed to modify and/or synthesize one or more particular preselected metabolites(s)). For example, using known recombinant or in vitro methods, LnmG may be substituted for a different naturally occurring discrete AT in a non-leinamycin biosynthesis system that relies, at least partially, on a discrete AT for loading of extender and starter molecules on PKS modules.

This approach facilitates the selective introduction of particular extender molecules at selected positions within a product based on a limited knowledge of the modular structure of the PKS and the extender molecule specificity of the substituted discrete AT. For example, using recombinant methods known in the art, a naturally occurring discrete AT associated with a type I polyketide system and specific for methyl malonyl CoA may be substituted with an alternative discrete AT, preferably LnmG (SEQ ID NO 257). Consequently, malonyl CoA extenders provided by the substituted LnmG may be utilized by a type I PKS module that naturally utilizes methyl malonyl CoA resulting in the production of a novel product with a predicted structure.

In a further embodiment of the present invention, a modular AT domain contained within a PKS module may be unnaturally rendered ineffective (i.e., deleted or inactivated by recombinant or in vitro methods) to provide a PKS module lacking the ability to itself load an extender molecule onto its ACP domain. Subsequently, a discrete AT acting in trans, such as LmnG (SEQ ID NO 257), could "rescue" the inactivated module and afford the effective loading of extender molecule on the PKS module so that a chain elongation step may occur. This approach is particularly advantageous over prior domain "swapping" approaches where an AT domain is deleted from a PKS module and a second AT domain is substituted into the modular structure creating the opportunity for protein misfolding, etc. Thus, for example, a site-directed mutation to key residues necessary for acyltransferase catalytic activity of a modular AT domain may be made by standard techniques and the AT domain, in inactivated form, allowed to reside in the modular PKS. The acyltransferase activity necessary to load an extender molecule onto the ACP of the "inactivated" PKS module could then be supplied in trans by a discrete AT, preferably a discrete AT having specificity for a different extender molecule than the inactivated AT domain (e.g., a discrete AT with specificity for malonyl CoA, such as LnmG (SEQ ID NO 257), could substitute for an inactivated modular AT domain with specificity for a methyl malonyl CoA extender; thus, a malonate unit would be incorporated into the product structure instead of a methyl malonate unit).

In a host cell, the discrete AT could be, for example, provided on a vector comprising a nucleic acid encoding at least a catalytic domain of a discrete AT. In addition, the PKS module may be provided on a different vector including a nucleic acid encoding the PKS module. Thus, a two plasmid heterologous system could be practiced wherein the different vector comprising at least the PKS module may further include coding sequence for additional PKS modules, preferably, modules sufficient to produce a predicted product.

In an in vitro embodiment, the discrete AT may be provided as a recombinantly expressed or purified version of a discrete AT provided in a addition to various isolated domains of a PKS or PKS/NRPS, including at least the "inactivated" PKS module requiring trans activity to load extender molecules. Thus, novel polyketides and polyketide/peptide products may be produced by the novel combination of discrete AT and modified PKS modules harboring "inactivated" modular AT domains wherein the discrete AT domain has a different extender molecule specificity than the "inactivated" AT domain.

A specific example meant for illustration purposes only, may be had by reference to the production of the natural polyketide 6-deoxyerythronolide B (6-dEB) by the type I PKS 6-deoxyerythronolide B synthase (DEBS). McDaniel et al. previously described the substitution of an AT cassette from module 2 of the rapamycin PKS to alter the extender unit specificity from methyl malonate CoA to malonyl CoA in modules 1–3, 5, and 6 of DEBS. (McDaniel et al., (1999) Proc. Natl. Acad. Sci. U.S.A. 96: 1846–1851.) However, substitution at module 4 of DEBS proved unsuccessful. Subsequently, Reeves et al. identified a possible route around the module 4 problem by site-directed mutagenesis of specific residues within module 4 to alter the module's extender specificity from methyl malonate to malonate. (See, e.g., Reeves et al. (2001) Biochemistry 40:15464–15470.) However, domain swapping (McDaniel et al. (1999)) and the alternative of site-directed mutagenesis (Reeves et al. (2001)) key substrate specificity residues are labor intensive approaches requiring extensive knowledge of sequence and structure of the modular AT domain.

In this regard, the present invention may be utilized to circumvent the disadvantages of the previous methods. For example, the specificity of DEBS modules 1–6, taken individually, in combination, or in their entirety may be had by inactivation of the well known catalytic residues (e.g., by site-directed mutagenesis) responsible for acyl transferase activity in ATs followed by providing a discrete AT, such as LnmG (SEQ ID NO 257), to supply, in trans, the required acyl transferase activity for the "inactivated" module. As described above, a two plasmid approach in a transformed host cell could be utilized wherein LnmG is encoded by a first plasmid and the respective modified module(s) of DEBs encoded by a second, different plasmid. In the case of DEBS, LnmG-AT (SEQ ID NO 257) would provide a substitution of a malonate unit for a methyl malonate unit and result in the production of 6-dEB analogs. For example, inactivation of the modular AT domain of DEBS module 4 and substitution of the LnmG acyl transferase activity, in trans, would result in the production of 6-desmethyl-6-deoxyerythronolide B (6-desmethyl-6-dEB), a valuable analog of the natural polyketide 6-dEB. Thus, the large-scale remodeling of a modular PKS is not necessary nor is extensive knowledge regarding the complexities of substrate specificity in the present invention.

In another embodiment of the invention, an in vitro method is provided for loading an ACP isolated from a type I PKS with an extender molecule by utilizing the trans acyltransferase activity of a discrete AT, preferably LnmG. Such an approach has been reduced to practice by the present inventors, as described in Example 2, such that holo-ACP domains may be loaded with extender molecule in vitro by the discrete AT LmnG (SEQ ID NO 257). Such an approach facilitates ease of assembly of directed biosynthethic systems, particularly in vitro systems where PKS or PKS/NRPS domains/modules may be specifically selected and combined in reactions in whatever order selected by the worker. For example, a holo-ACP domain may be incubated with an extender molecule and a specific discrete AT selected for its extender molecule specificity under conditions sufficient to load the extender molecule onto the holo-ACP domain. In a subsequent reaction, the loaded holo-ACP domain may be contacted with a PKS domain to facilitate the starting step of polyketide chain elongation or a further chain elongation step wherein the PKS domain carries a nascent polyketide elongation product to be coupled to the extender molecule. General discussions of in vitro synthesis are provided in Section VII above.

Discrete ATs may also be substituted for modular AT domains in type I PKS or type I PKS/NRPS according to domain swapping strategies well know in the field, and previously described herein (e.g., recombinant methods and in vitro synthetic methods). Domain swapping may be particularly attractive in directed biosynthesis of a predicted polyketide product wherein the desired product necessitates the use of PKS domains with elongation activities utilizing particular extender or starter molecules. As a general example, a type I PKS module having an AT domain specific for loading of malonyl CoA may be altered by the substitution of an AT domain having extender molecule specificity for methoxy malonyl CoA. It is envisioned that, for example, a discrete AT may be, instead of utilized in a trans manner, substituted into the modular structure of a type I PKS or type I PKS/NRPS to provide acyltransferase activity in a noniterative manner, in similar fashion to the wide variety of naturally-occurring type PKS having noniterative AT domains within their modular structure. Such domain swapping has been previously effective to produce novel polyketides and/or polyketide/peptide hybrid products. (See, e.g., McDaniel et al. (1999)) Combining a discrete AT into a PKS or PKS/NRPS has advantages where simplicity in a biosynthetic system is desired, in particular, where a single gene cluster unit simplifies transformation, maintenance of transformed cells, and stable expression of biosynthetic products.

The discovery by the present inventors, that LnmI and LnmJ are type I PKSs consisting minimally of the KS and ACP domains but lacking the cognate AT domain and that LnmG is a discrete AT enzyme that interacts with LnmIJ to form functional type I PKS modules by providing the AT activity in trans, unveils a new architecture and mechanism for type I PKSs and suggest an alternative model for type I PKS with KS and ACP as the minimal core structure. Preliminary phylogenetic analysis indeed has led to the identification of LnmG homologs (FIGS. 14 and 15), which, in a mechanistic analogy to LnmG, could provide the AT activity in trans to the PKS modules for polyketide biosynthesis. Thus, LnmG homologs and/or LnmG-like ATs, no matter which type I PKS or type I PKS/NRPS system initially isolated from, could be utilized in similar fashion to the LnmG-based embodiments set forth above.

Figure 14:
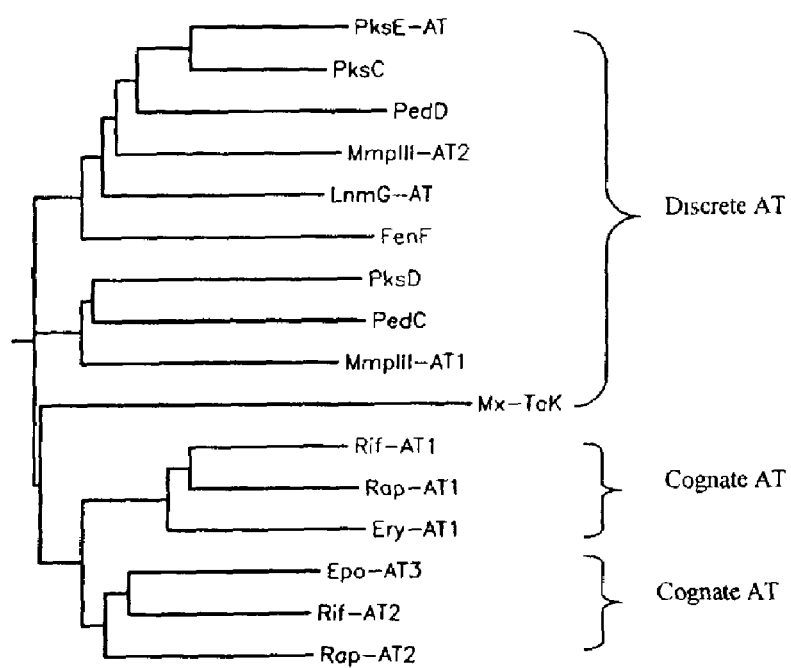
FIG. 14 depicts a phylogenetic analysis of discrete ATs and cognate AT domains of type I polyketide synthases and type I polyketide synthase/nonribosomal peptide synthetases performed by the CLUSTAL W program (version 1.81), using Gonnet series weight matrix with a gap open penalty of 10.00 and a gap extension penalty of 0.2. (Higgins, D. G., Thompson, J. D. and Gibson, T. J. (1996); Methods Enzymol., 266, 383–402).

Phylogenetic analysis of LnmG AT (SEQ ID NO 257) and its homologs from other "AT-less' type I PKS clusters and their relationships to cognate ATs from type I PKS clusters are shown in FIGS. 14 and 15. The LnmG AT (SEQ ID NO 257) and its homologs fall into distinct groups that differ from cognate ATs of type I PKSs. Multiple sequence alignment and phylogenetic analysis were performed by the CLUSTAL W program (version 1.81), using Gonnet series weight matrix with a gap open penalty of 10.00 and a gap extension penalty of 0.2 [Higgins, D. G., Thompson, J. D. and Gibson, T. J. (1996) Using CLUSTAL for multiple sequence alignments. Methods Enzymol., 266, 383–402]. We predict that PksC (SEQ ID NO 253)/PksD (SEQ ID NO 255)/PksE-AT (SEQ ID NO 254) (for the unknown polyketide in Bacillus subtilis (Albertini, A. M., Caramori, T., Scoffone, F., Scotti, C., & Galizzi, A. (1995) Microbiology 141, 299–309)), PedC (SEQ ID NO 251)/PedD (SEQ ID NO 255) (for pederin in a bacterial symbiont of Paederus beetles (Piel, J. (2002) Proc. Natl. Acad. Sci. USA 98, 14808–14813)), MmpIII-AT1 (SEQ ID NO 252)/AT2 (SEQ ID NO 256) (for mupirocin in Pseudomonas fluorescens (accession number AF318063)), FenF (SEQ ID NO 258) (for mycosubtilin in Bacillus subtilis ATCC6633 (Duitman, E. H. et al. (1999) Proc. Natl. Acad. Sci. USA 96, 13294–13299)), and Mx-TaK (SEQ ID NO 265) (for Ta1 in Myxococcus xanthus (Paitan, Y., Alon, G., Orr, E., Ron, E. Z., & Rosenberg, E. (1999) J. Mol. Biol. 286, 465–474.)), acting in a mechanistic analogy to LnmG (Cheng, Y.-Q., Tang, G.-L., & Shen, B. (2002) J. Bacteriol. 184, 7013–7024), load the malonyl CoA extender unit onto the AT-less PKS modules in trans for polyketide biosynthesis in these clusters. For cognate ATs from rifamycin (Rif), rapamycin (Rap), erythromycin (Ery), and epothilone (Epo) clusters, protein accession numbers are given after the protein names: R1f-AT1 (SEQ ID NO 259) and R1f-AT2 (SEQ ID NO 263), AF04570; Rap-AT1 (SEQ ID NO 260) and Rap-AT2 (SEQ ID NO 264), X86780; Ery-AT1 (SEQ ID NO 261), Q03131; Epo-AT3 (SEQ ID NO 262), AF217189. Abbreviations are: MCoA for malonyl CoA and mMCoA for methyl malonyl CoA.

The distribution in the phylogenic tree suggests that the discrete AT proteins associated with certain type I PKSs are evolutionarily distant from the cognate AT domains of other type I PKSs. Therefor, LnmG represents a member of a discrete AT family quite distinct from the cognate AT domains of known type I PKSs. Proteins within the bracket in FIG. 14 are anticipated to be LnmG homologs. LnmG-like characteristics include the following properties: (1) the AT is encoded by a discrete gene physically set apart from the sequences encoding the modules of the respective type I PKS or type I NRPS-PKS without at least one cognate AT domain; and (2) the AT provides an acyl transferase activity in trans to the associated type I PKS or type I NRPS-PKS lacking at least one cognate AT domain. For the purposes of practicing the present invention, LnmG homologs are considered the equivalent of LnmG and may be substituted for LnmG in the various methods described above and claimed below, unless noted otherwise.

EXAMPLES

The following examples are offered to illustrate, but not to limit the claimed invention.

Example 1

The Biosynthetic Gene Cluster for the Antitumor Macrolactam Leinamycin from Streptomyces atroolivaceus: a Novel Approach for Identifying and Cloning Thiazole Biosynthetic Genes In this example, we describe (1) the construction of a cosmid library of S. atroolivaceus, (2) PCR amplification of a conserved cyclase-domain probe, (3) identification and mapping of overlapping cosmid clones that cover the target Lnm biosynthetic gene cluster and flanking regions, (4) the purification, HPLC and mass spectral (MS) analyses of Lnm production in *S. atrooliveceus*, (5) the sequencing and sequence analysis of a 11 kb DNA from the gene cluster, (6) the development of a genetic system, and (7) the confirmation of cloned gene cluster encoding Lnm biosyntheses by gene disruption to generate Lnm non-producing mutants.

Materials and Methods

Genomic DNA Isolation.

Standard protocols are followed in this study (Kieser et al. (2000) *Practical Streptomyces genetics*. The John Innes Foundation, Norwich, England; Sambrook et al. (1989) *Molecular Cloning, A Laboratory Manual* (2nd ed.). Cold Spring Harbor Laboratory Press).

Cosmid Library Construction.

(1) Cosmid vector pOJ446: The ready-for-use pOJ446 was from lab stock (Liu and Shen (2000) *Antimicrob Agents Chemother.* 44: 382–392; Smith et al. (2000) *Antimicrob Agents Chemother.* 44: 1809–1817; Du et al. (2000) *Chem. Biol.* 7: 623–642). The sample contains the Hpa-digested, dephosphorylated, and then BamHI-digested pOJ446, i.e. the mixture of a ~2 kb arm and a ~8 kb arm.

(2) Preparation of partially digested DNA inserts: Genomic DNA of *S. atroolivaceus* was partially digested by MboI (New England Biolabs, MA) following the standard protocol (Rao et al. (1987) *Methods in Enzymol.* 153: 166–198; Sambrook et al., supra). A total of 50 µg of DNA was diluted to 900 µl with 10 mM Tris-HCl (pH 8.0) buffer, and 100 µl of 10× buffer was added. Let the DNA solution sit on ice for at least 2 hrs. Label 10 1.5-ml eppendorf tubes and keep on ice. Aliquot 40 µl of DNA solution to tube #1; aliquot 20 µl of DNA solution to the rest tubes (#2 to #10). Ten units (1 µl) of MboI was added to tube #1 and mixed well on ice. Twenty µl of mixture #1 was transferred to tube #2 and mixed. Twenty µl of mixture #2 was transferred to tube #3 and mixed, and so on until tube #9. Discard 20 µl of mixture #9. No enzyme was added to tube #10. Incubate the 10 reaction mixtures in 37° C. water bath for 30 min. Stop reaction by adding 2 µl of 0.2 M EDTA (pH 8.0; final concentration 5 mM). Heat reactions at 70° C. for 15 min to inactivate enzyme. Add 4 µl 6× DNA loading buffer to each tube and run 10 µl of each sample in a 0.3% gel. Use intact λ DNA as control. Run gel slowly for at least 4 hrs. Use the optimal conditions for large-scale DNA partial digestion as follow: 30 µg DNA with 0.6 unit of MboI in 300 µl volume. Partially digested DNA solution was diluted with equal volume of ddH2O and extracted once with phenol:chloroform, once with chloroform, and precipitated ethanol. Redissolve DNA in 180 µl ddH2O and treated with 10 units of CIP (NEB) at 37° C. for 4 hrs. Perform again phenol: Chloroform extraction and ethanol precipitation. Finally redissolve DNA in 10 µl ddH2O (~2 µl/ul).

(3) Vector-insert ligation: Five µl of MboI partially digested, dephosphorylated *S. atroolivaceus* DNA fragment (~10 µg) was ligated with 2 µl of HpaI-cut, dephosphorylated and BamHI digested pOJ446 (~4 µg) in the volume of 10 µl with 100 units of T4 DNA ligase (NEB) at 16° C. for overnight.

(4) Packaging for the ligation mixture: Four µl of ligation mixture was packaged with one vial of Gigapack III XL extract (Stratagene, CA) according to manufacturer's instruction. Five hundred µl of SM buffer containing the packaged phage particles was obtained and stored at 4° C.

(5) Determination of the titer of the cosmid library and library amplification: Fresh host cell *E. coli* XL1-Blue MRF' suspension in 10 mM MgSO4 was prepared according to manufacture's instruction (Stratagene). Twenty five µl of 1:10 and 1:50 diluted phage particle solutions were mixed with 25 µl of host cells ($OD_{600}$=0.5) and incubated at 37° C. for 20 min. Four hundred fifty µl of LB medium was added to each sample and incubated at 37° C. for 1 hr with gently shaking. Aliquots (50 µl, 450 µl) of each sample were spread onto [o] 150 mm LB plates (with 100 µg/ml apramycin). Plates were incubated at 37° C. overnight. The number of colonies was counted and the titer of the cosmid library was calculated. Cosmid DNA was prepared from 16 random clones, digested with BamHI and fragments were separated in a 0.8% gel to test the quality of library. An aliquot of the primary phage stock equivalent to 3 times of the genome size of *S. atroolivaceus* was transducted into XL1-Blue MRF' cells and grown on LB plates with 100 µl/ml apramycin. Cells of the colonies were collected into LB medium with apramycin. Sterile glycerol was added to a final concentration of 20% and stored at −80° C. as the permanent cosmid library stock.

Degenerate PCR Primers.

Primer set for cyclase-domain amplification were: CyFP (5'-GCGCCACGAGCCGTTYCCNYTNAC-3', SEQ ID NO:215) and CyRP (5'-GCCCAGGTTGGAGGTGAR-SACNACNGG-3', SEQ ID NO:216); primer set for oxidase-domain amplification were: OxFP (5'-GCCGGCTCCAC-CTACCCNGTNCARAC-3', SEQ ID NO:217) and OXRP (5'-CATCAGCAGCTGGGTCATGKMNCCNGCYTC-3', SEQ ID NO:218). These primers were designed by the "Consensus-Degenerate Hybrid Oligonucleotide Primer" strategy (Rose et al. (1998) *Nucleic Acids Res.* 26: 1628–1635) and synthesized by campus oligo syntheses facility (UC-Davs, CA). Primer set for PKS were: PKSFP (5'-GCSTCCCGSGACCTGGGCTTCGACTC-3', SEQ ID NO:219) and PKSRP (5'-AGSGASGASGAGCAGGCGGT-STCSAC-3', SEQ ID NO:220); primer set for PTS were: PTSFP (5'-ATCTACACSTCSGGCACSACSG-GCAAGCCSAAGGG-3', SEQ ID NO: 221) and PTSRP (5'-AWTGAGKSICClCCSRRGIMGAAGAA-3', SEQ ID NO:222). These primers were obtained from lab stock.

PCR Amplification

All PCR reactions were performed on a GeneAmp 2400 (Perkin Elmer, CA) thermocycler with touchdown programs. A typical PCR reaction (50 µl volume) contains of 1× PCR buffer with 1.5 mM $MgCl_2$, 5 ng of template, 7.5% DMSO, 100 nM dNTPs, 25 pmol each primer, 2.5 units of Tag DNA polymerase (Boehringer Mannheim Biochemicals, IN). For cyclase-domain amplification, the program was: pre-run denaturation (4 min at 94° C.)→10 cycles of ramp amplification (45 sec denaturation at 94° C.→1 min annealing starting from 65° C. to 55° C. in 10 cycles→1.5 min extension at 72° C.)→25 cycles of amplification with a constant annealing temperature at 55° C.→post-run extension (10 min at 72° C.). For oxidase-domain amplification, the PCR program was the same except that the ramp temperature was from 60° C. to 50° C. and the extension time was 45 sec. For PKS PCR, the extension time was 1 min instead. For PTS PCR, the program was identical to that for cyclase-domain amplification. For amplification of a large fragment containing both cyclase-domain and oxidase-domain at each end, CyFP and OxRP were used as PCR primer set. The ramp temperature was from 65° C. to 55° C., and the extension was 5 min.

Subcloning and Sequencing

PCR mixtures were separated in agarose gels. Interested fragments were recovered by Gel Extraction kit (Qiagen, CA). PCR fragments were subcloned into pGEM-T Easy vector (Promega, WI). Other restriction enzyme-generated DNA fragments were subcloned into the appropriate sites of pBSSK vector (Strategene), or pSP72, or pGEM-series (Promega). Recombinants plasmid DNAs were prepared by QiaPrep Spin Miniprep kit (Qiagen). DNA sequencing was performed by Davis DNA Sequencing. Inc. (Davis, Calif.). DNA sequences were analyzed with GCG package (GCG Inc. WI) and blasted against NCBI databases.

Library Screening.

PCR-amplified 1.1-kb cyclase-domain fragment was labeled with digoxigenin (BMB) and used as probe to screen the cosmid library following the standard colony-hybridization procedure (Sambrook et al., supra). Positive clones were isolated and their cosmid DNAs were prepared by alkali lysis method (Id). Subclonings from the left end of Cosmid 11 and the right end of Cosmid 1 (pYC$_9$-2.1 and pYC25, respectively) were used as probes to perform cosmid walkings.

Cosmid Clone Mapping and Shotgun Subcloning.

Cosmid DNA was digested with BamHI, NcoI or AatII and separated in 0.8% agarose gels. The patterns of fragments were analyzed to generate a contig map. Southern hybridizations were performed to confirm the validation of the initial screening and the mapping. All 18 BamHI fragments (except the liberated 8 kb cosmid vector) from two overlapping cosmids (Cosmid 1 and 11) were subcloned into the BamHI site of pBSSK by shotgun cloning method.

Fermentation, Purification and HPLC Analysis of Leinamycin

Fermentation method was adopted from Hara et al. (1989) *J. Antibiot.* 42: 1768–1774. Fifty ml of seed culture was allowed to grow for 48 hrs at 22° C. with adequate shaking and used 10 ml to inoculate 2×50 ml of fermentation broth. Culture was allowed to ferment for 48 hrs at 22° C. Moisturized Diaion HP-20 resin (SUPELCO, PA) was added to 5% (W/V) at 18 hrs after inoculation. Fermented broth was pooled and the pH was adjusted to pH 2.0 with $H_2SO_4$. Resin was recovered from the broth by filtration through two layers of cheesecloth. Crude Lnm preparation was eluted from the resin with 10 vol of methanol and solvent was concentrated by vacuum evaporation. HPLC separation of leinamycin from contaminants was performed with a Microsorb MV C18 reverse-phase column (Varian, CA) on a Dynamax SD-200 HPLC system (Rainin, CA). Authentic leinamycin (10 mg/ml) was provided by Tokyo Research Laboratories (Kyowa Hakko Kogyo Co., Japan).

PEG-mediated Protoplast Transformation of *S. atroolivaceus*.

A 1.1-kb PCR amplified Cy-domain fragment was subcloned into: (1) pOJ260/EcoRI site to make the construct pYC12. (2) pKC1139/EcoRI site to make the second construct pYC20; DNA of pYC12 and pYC20 was prepared from the non-methylated host strain ET 12567, denatured with alkali solution and used for PEG-mediated protoplast transformation (Liu and Shen (2000) *Antimicrob Agents Chemother.* 44: 382–392).

Conjugation between *S. atroolivaceus* and *E. coli* S17-1

Experiments of conjugation between *S. atroolivaceus* and *E. coli* S17-1 were performed by previous described procedure (Liu and Shen (2000) *Antimicrob Agents Chemother.* 44: 382–392) with modifications. Three exconjugates (named YC12C1, YC12C2 and YC12C3) obtained with pYC12 were further purified, and the genomic DNA was prepared for Southern analysis.

*S. atroolivaceus* Cosmid Library Construction

High molecular-weight genomic DNA was isolated from *S. atroolivaceus* by a modified procedure (Rao et al. (1987) *Methods in Enzymol.* 153: 166–198; Kieser et al. (2000) *Practical Streptomyces genetics.* The John Innes Foundation, Norwich, England). The major modification was to extend the lysis time to up to 60 min. The cell wall of *S. atroolivaceus* seemed to be quite resistant to lysozyme treatment. Initial attempts that used a 30-min lysis time only obtained DNA samples with an average of ~40 kb in size. Partial digestion by MboI was done with decreasing amount enzyme. A portion of the digested samples were analyzed on agarose gel to obtain the correct size of genomic DNA fragment for library construction.

The *S. atroolivaceus* primary cosmid library contains about $1.675 \times 10^5$ colony-formatting-unit (cfu) in 500 µl SM buffer (335 cfu/µl), which is equivalent to 50 fold of the genome size. Analyses by alkali mini-preparation and BamHI-digestion of 16 randomly selected cosmid clones indicated that the average size of inserts is about 40 kb. The library was amplified once in XL1-Blue cells. Sterile glycerol was added to the cell culture to 20% final concentration. Aliquots (10 ml each) of the amplified library were stored at −80° C. The titer of this amplified library was about $10^5$ cfu/µl.

PCR Amplification of a Cyclase (Cy)-Domain.

An expected 1.1 kb fragment was amplified with the Cyclase-domain PCR primer set (CyFP+CyRP). Although the control reactions with single primer also yield amplified bands, the 1.1-kb fragment seems to be a unique band to the reaction with the presence of both primers. This fragment was cloned into pGEM-T Easy vector (Promega) as pYC1. Both ends of pYC1 were sequenced. Blast results indicated its homology to the cyclase-domains of known NRPSs.

Mapping the Lnm Cluster, Subcloning and Partial Sequencing

Digoxigenin labelled 1.1-kb Cy-domain probe was used to screen about 4×1000 cfu of cosmid library, 15 well-isolated positive clones were obtained. Cosmid DNA from 12 clones was prepared and subjected to enzyme (BamHI) digestion, Southern hybridization and PCR diagnosis for the presence of Cy-domain, Ox-domain, PKS-domain or/and PTS-domain.

Figure 2:
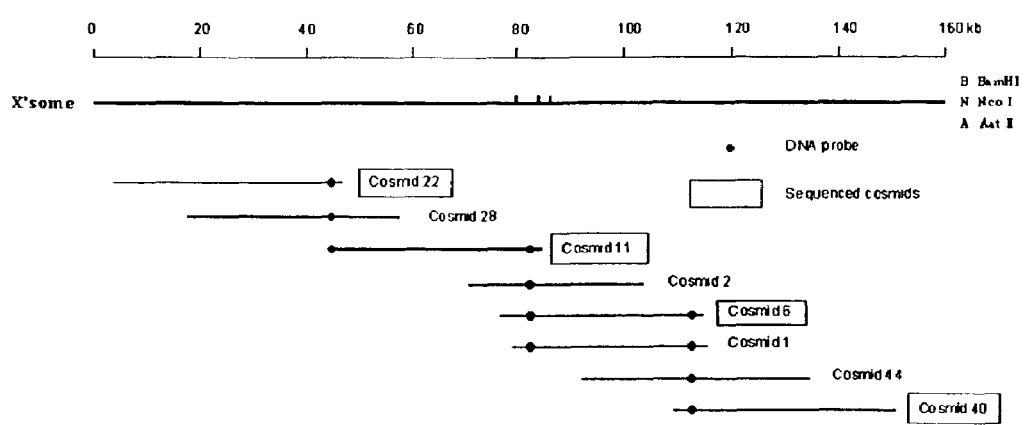
FIG. 2 shows a map of the 132 kb DNA from *S. altroolivaceus* that harbors the leinamycin biosynthetic gene cluster.
Figure 3:
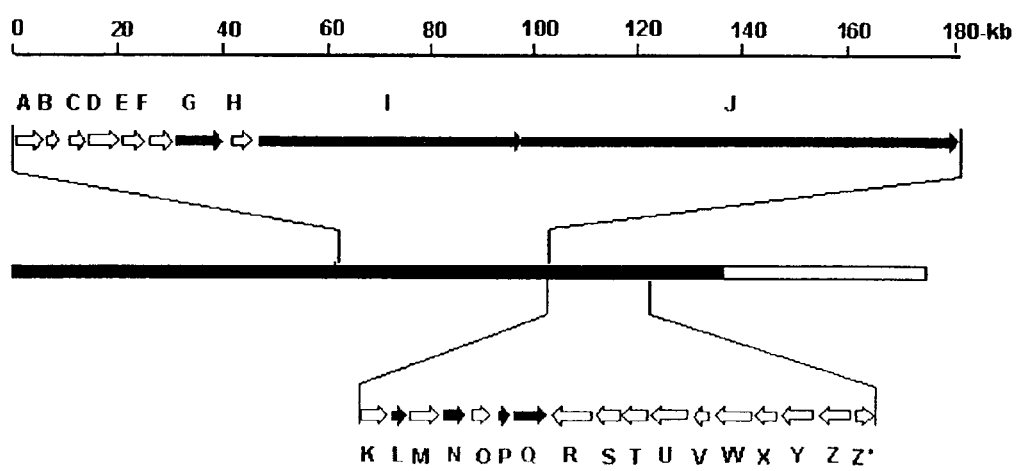
FIG. 3 shows the genetic organization n of the leinamycin biosynthetic gene cluster from *S. altroolivaceus*. NRPS and PKS genes are shown by solid arrows.

Initially, four cosmids (#1, #2, #6 and #11) were found to cover the longest chromosome region (total of 63 kb) and the PCR diagnosis data supports the predicted domain-organization. Later, the other ends of cosmid #1 and #11 were subcloned as pYC25 and pYC9-2.1, respectively, and were used as probes to obtain more cosmid clones extending to both directions. The relative position of those cosmids has been mapped and is illustrated in FIG. 2. Subsequently, the sequence of the entire lnm gene cluster and its flanking regions (~135 kb) was determined and analyzed (see FIG. 3). Deduced functions of the open reading frames (ORFs, SEQ ID NOs 2–110) in the leinamycin biosynthetic gene cluster are summarized herein in Table 1 and Table 2.

The Development of a Genetic System for *S. atroolivaceus*

*S. atroolivaceus* grows very well at 30° C.; it doesn't grow at temperature beyond 35° C. It is found to be highly sensitive to both apromycin (Am) and thiostrepton (Thio) (complete inhibition of growth at 10 µg/ml and 3 µg/ml, respectively). Thus, *E. coli-Streptomyces* shuttle vectors pOJ260 (suicide vector, $Am^R$) and pKC1139 (self-replicating vector, $Am^R$) were chosen to make the gene-disruption constructs pYC12 and pYC20, respectively. The concentration of antibiotic (Am) for selection of transformants/exconjugates is 50 µg/ml.

TSB medium gives the best yield for protoplast preparation, however the regeneration ratio is very low (less than 0.01%). Protoplasts made from TSB with 30% sucrose has a regeneration ratio of 0.2%. YEME gave the highest protoplast regeneration ratio of 0.6%. All the protoplast samples were generated on R2YE plates with 10 mM $MgCl_2$ supplemented. Approximately $1\times10^9$ protoplasts and 2 μg DNA were used for each transformation experiment. Trial experiments were performed with pYC20 construct. Seven apparent positive transformants were obtained from the initial selection plates. Only 1 remained well-growing after 2 rounds of re-inoculation on vegetative-growth medium (TSB) and spore-generation medium (ISP-4). The calculated transformation efficiency was about $8\times10^{-8}$.

Since the combined efficiency of transformation and regeneration was only about $1\times10^{-9}$, which is very low, a conjugation approach was pursued, with surprising success. Spores ($1\times10^9$) were heat-shocked for 20 min at 42° C. instead of 10 min at 50° C., followed by incubation at 30° C. for up to 6 hours. The germination of spores was monitored by microscopic checks every 30 min from 4 hours after heat-shock. *E. coli* S17-1 (bearing either pYC12 or pYC20) culture was freshly prepared. Conjugation was conducted on modified ISP-4 medium. After incubation at 28° C. for 5 days, about 18 and 500 apparent positive ex-conjugates grew out from the initial selection plates with pYC12 and pYC20, respectively. Therefore, the calculated conjugation/integration efficiency for non-self-replicating construct pYC12 was approximately $1.8\times10^{-8}$, and the conjugation efficiency for self-replicating construct pYC20 was $5\times10^{-7}$. Three exconjugates (named YC12C1, YC12C2 and YC12C3) obtained with pYC12 were further purified and analyzed.

Genomic DNA hybridization confirmed the correct disruption of the target NRPS-gene in *S. atroolivaceus*. With the Cy-domain as probe, wild type gave a hybridized band of 4.6 kb in size with NcoI digestion, while all three independent exconjugates (YC12C1 to C3, appeared to be identical) gave a band of 9.2 kb, which is the expected size after vector single-crossover event. With the vector (pOJ260) DNA as probe, wild type DNA was not hybridized, while three exconjugates had the same 9.2 kb positive band.

Analysis of Lnm Production in *S. atroolivaceus* Wild Type and Mutants

Figure 10:
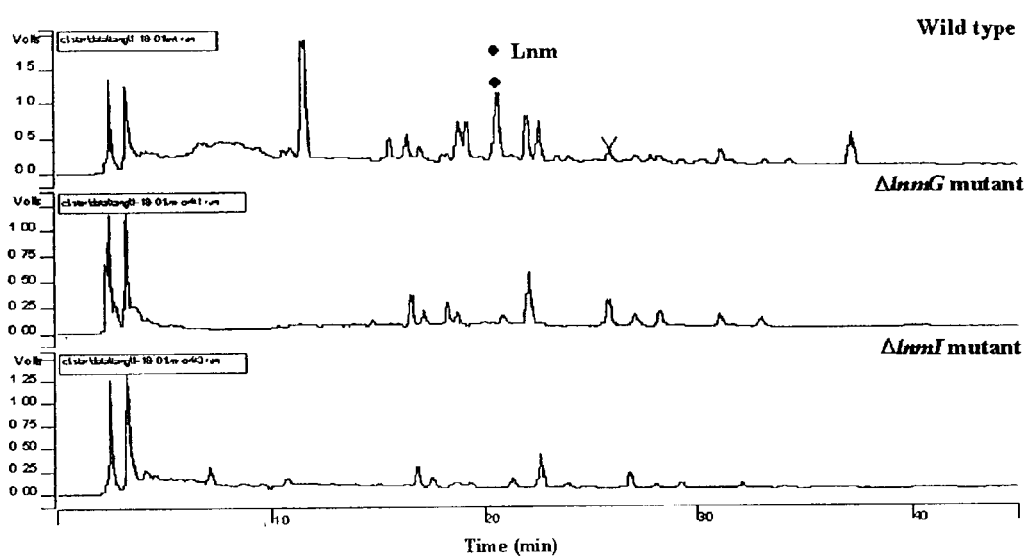
FIG. 10 shows the results of targeted gene inactivation of lnmG and lnmI on leinamycin biosynthesis and establishes the involvement of the cloned gene cluster in leinamycin production. LnmG is a di-domain proteins that shows high amino acid sequence homology to known polyketide synthase. LnmI is multi-domain protein that shows high amino acid sequence homology to known polyketide synthase and nonribosomal peptide synthetase. In activation of lnmG and lnmI, respectively, by targeted gene replacement experiments, produces *S. atroolivaceus* mutant strains that no longer produce leinamycin and its biosynthetic intermediates. This was confirmed by HPLC analysis.

Crude Lnm sample was extracted from 50 ml of 4-day 2-step fermentation broth, following the described procedures (Hara et al. (1989) *J. Antibiot.* 42: 1768–1774). Lnm production was further analyzed by HPLC (FIG. 10). Samples purified from HPLC were also subjected to Mass Spectrometry analysis. Lnm has the molecular formula of $C_{22}H_{26}N_2O_6S_3$ and a molecular weight of 511.2 (Hara et al. (1989) *J. Antibiot.* 42: 1768–1774). The dominant MS peak was found in wild type Lnm sample but not in YC12C1. This confirmed the HPLC results that the missing HPLC peak is indeed that of Lnm (FIG. 10).

In summary, a 180 kb gene cluster encoding lnm biosynthesis was cloned from *S. atroolivaceus*, 135 kb of which was sequenced. Sequence analysis revealed that Lnm is biosynthesized by a hybrid nonribosomal peptide synthetase and polyketide synthase system. These genes can now be used to improve the production of leinamycin, to engineer microbial strains for the production of novel leinamycin analogs as drug leads, and to use as genetic materials in combination with other nonribosomal peptide synthetase genes, polyketide synthase genes, and genes encoding other enzymes responsible for natural product biosynthesis in combinatorial biosynthesis to generate chemical structural diversity.

An efficient genetic system for in vivo manipulation of natural product biosynthesis in *S. atroolivaceus* has been developed. Conditions for the introduction of plasmid DNA into *S. atroolivaceus* have been optimized for both protoplast-mediated transformation and *E. coli-S. atroolivaceus* conjugation. Genetic engineering of leinamycin biosyntheses in *S. atroolivaceus* has been demonstrated by disrupting the NRPS module, resulting to the isolation of Lnm noproducing *S. atroolivaceus* mutants. The latter not only confirmed the cloned gene cluster encoding Lnm biosynthesis but also demonstrated the feasibility to making novel Lnm analogs in *S. atroolivaceus* by manipulating genes governing Lnm biosynthesis.

Example 2

A Discrete Acyltransferase Associated with a Type I Polyketide Synthase

Figure 11:
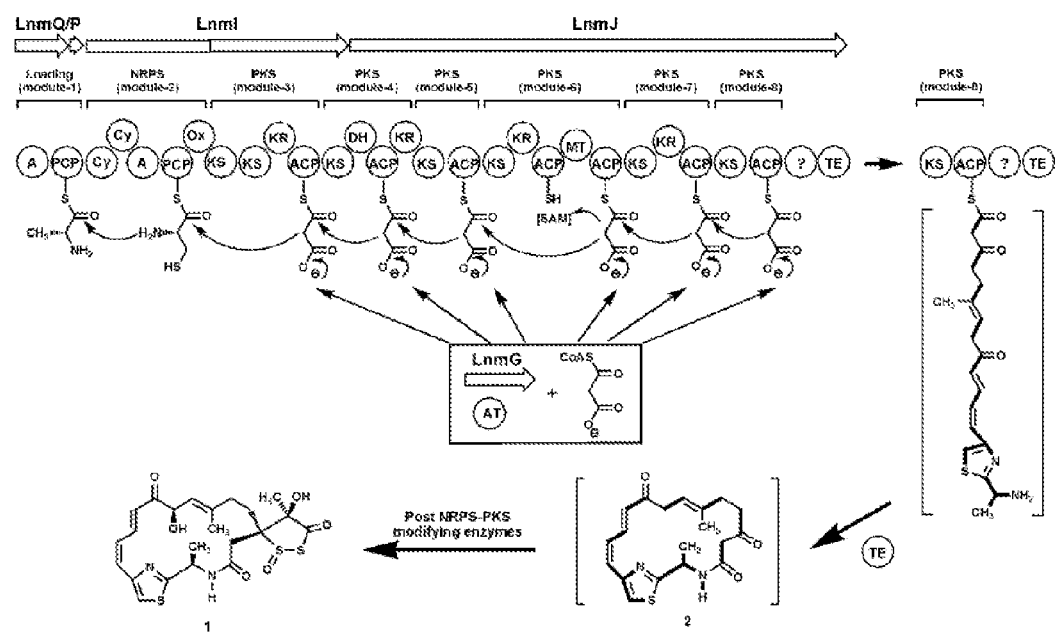
FIG. 11 shows LNM (1) biosynthesis hypothesis and modular organization of the Lnm hybrid NRPS-PKS megasynthetase with a discrete LnmG AT enzyme loading the malonyl CoA extender to all six PKS modules. Structures in brackets are hypothetic. It is not known if one or both ACPs in module-6 are loaded with the malonyl group in vivo, although LnmG prefers ACP6-2 in vitro. Abbreviations are: A, adenylation; ACP, acyl carrier protein; AT, acyltransferase; Cy, condensation/cyclization; DH, dehydratase; KR, ketoreductase; KS, β-ketoacyl synthase; MT, methyl transferase; NRPS, nonribosomal peptide synthetase; Ox, oxidation; PCP, peptidyle carrier protein; PKS, polyketide synthase; TE, thioesterase.

In this example, we describe the in vitro loading of ACP domains of leinamycin PKS by LnmG, a discrete AT (SEQ ID NO 257). We have previously cloned the lnmGHI genes (SEQ ID NOs 43–45), demonstrated that this locus is essential for leinamycin production, and localized the lnm biosynthesis gene cluster to a 172-kilobase (kb) DNA region from *S. atroolivaceus* S-140 (SEQ ID NO 1). DNA sequence analysis of the four overlapping cosmids, pBS3004, pBS3005, pBS3006, and pBS3007, revealed 72 open reading frames (ORFs). Sequential inactivation of ORFs from both ends of the sequenced region led to the assignment of the lnm gene cluster to consist of 27 ORFs, of which two (lnmQ (SEQ ID NO 51) and lnmP (SEQ ID NO 82)) encode nonribosomal peptide synthetase (NRPS), one (lnmI) (SEQ ID NO 45) encodes a hybrid NRPS-PKS, and one (lnmJ) (SEQ ID NO 46) encode a PKS (FIG. 11).

Materials and Methods

Sequence Analysis of the lnm Gene Cluster and Determination of the lnm Gene Cluster Boundaries.

The lnm gene cluster (SEQ ID NO 1) was previously identified and mapped to five overlapping cosmids, pBS3004, pBS3005, pBS3006, pBS3007, and pBS3008. DNA sequencing of the first four cosmids yielded a 135,638 base pair (bp) contiguous DNA sequence. Bioinformatic analyses of DNA sequence were done with the Genetics Computer Group (GCG) program (Madison, Wis.), revealing 72 orfs. The overall GC content of the sequenced region is 72.4%. Functional assignments were made by comparison of the deduced gene products with proteins of known functions in the database and summarized in the GenBank entry under accession number AF484556. The boundaries of lnm gene cluster were identified by gene replacement of orf(−13)(SEQ ID NO 24)), orf(−11)(SEQ ID NO 26), orf(−2)(SEQ ID NO 35), orf(−1)(SEQ ID NO36), and lnmA (SEQ ID NO 37) for upstream boundary and of orfZ'(SEQ ID NO 63), orf(+1)(SEQ ID NO 64), orf(+2)(SEQ ID NO 65), orf(+3)(SEQ ID NO 66), orf(+4)(SEQ ID NO 67), and orf(+6)(SEQ ID NO 69) for downstream boundary, respectively. Inactivation of genes within the lnm gene cluster abolished LNM production, whereas that of genes outside the lnm gene cluster had no effect on LNM production. LNM production and isolation from both the wild-type and recombinant *S. atroolivaceus* strains were carried out as reported previously. HPLC analysis were carried out on a Microsorb-MV C-18 column (5μ, 100 Å, 250×4.6 mm, Varian, Walnut Creek, Calif.), eluted with a gradient from 100% buffer A (20% $CH_3CN$, pH 3.6 with HOAc) to 68% buffer B (80% CH$_3$CN, pH 3.6 with HOAc) in 40 min at a flow rate of 1 ml/min and UV detection at 320 nm.

LnmQ and LnmP are NRPS adenylation (A) enzyme and peptidyl carrier protein (PCP), respectively, constituting the loading module; LnmI contains the previously characterized thiazole-forming NRPS module as well as PKS module 3 and the KS domain of PKS module 4; and LnmJ harbors PKS modules 4 to 8 plus a TE domain. The Lnm megasynthetase-templated synthesis of 1 (FIG. 11) could be envisaged to begin at LnmQ and end with the cyclization of the full-length linear peptide-polyketide intermediate by the TE domain of LnmJ to yield a macrolactam intermediate such as 2 (FIG. 11). Although it remains unclear what the origin of the 1,3-dioxo-1,2-dithiolane is and how it is spiro-fused to the 18-membered macrolactam ring, subsequent modification of 2 by the action of post-PKS enzymes could be envisaged to furnish 1 (FIG. 11). The deduced Lnm NRPS and PKS functions are consistent with what would be required for the biosynthesis of 1 from the amino acid and acyl CoA precursors. However, the Lnm hybrid NRPS-PKS megasynthase is characterized by several intriguing features and, most strikingly, it lacks the cognate AT domain from all six PKS modules (FIG. 11).

Unusual Features Predicted on DNA Sequence for the Lnm Hybrid NRPS-PKS Megasynthetase.

The most striking feature of the Lnm hybrid NRPS-PKS megasynthetase is the lack of cognate AT domain from all six PKS modules. Others unusual features include: (1) a loading NRPS module consisting of discrete A and PCP proteins, (2) tandem Cy domains for the thiazole-forming NRPS module, (3) tandem KS domains and the absence of a dehydratase (DH) domain for PKS module 3, (4) tandem ACP domains and an integrated methyl transferase (MT) domain for PKS module 6, (5) the absence of a DH domain for PKS module 6 and of a DH and an enoyl reductase (ER) domains for PKS module 7, and (6) the presence of an extra domain unknown to PKS between PKS module 8 and TE.

Figure 12:
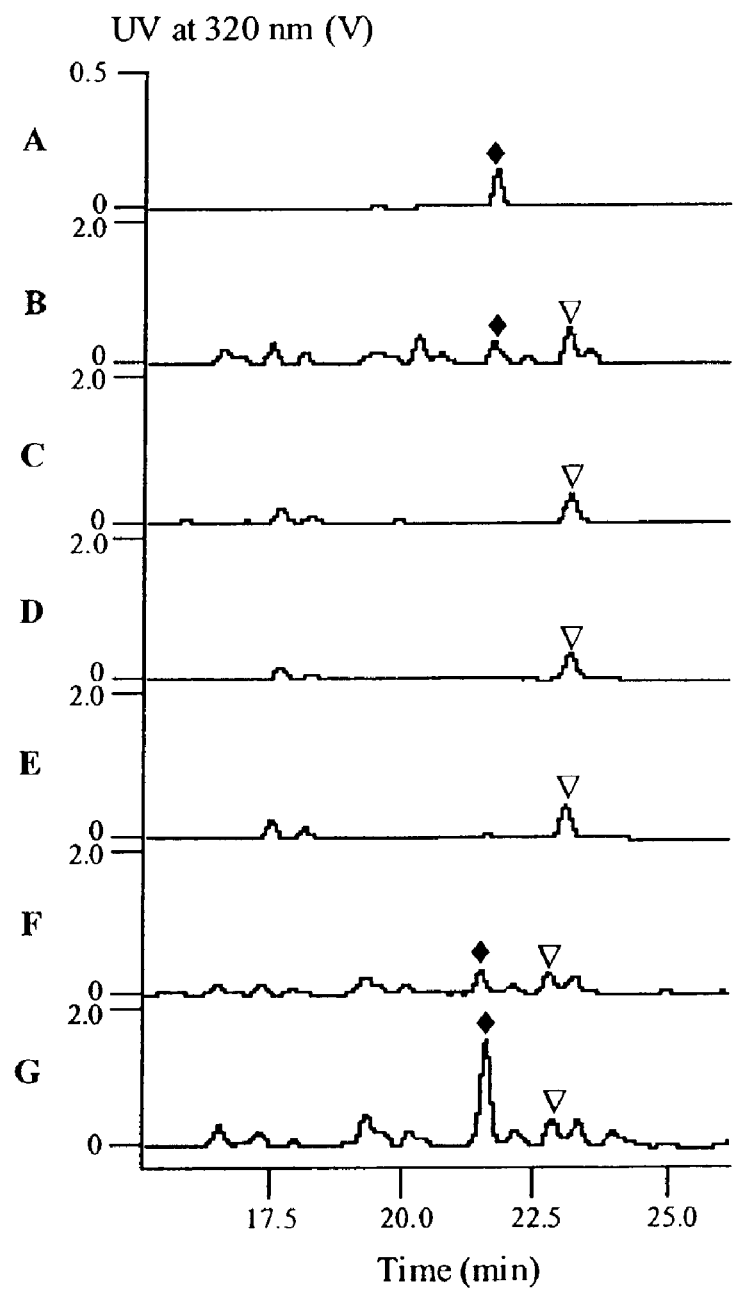
FIG. 12 illustrates HPLC analysis of LNM production by wild-type and recombinant *S. atroolivaceus* strains. (A) LNM standard, (B) S-140, (C) SB3001 (ΔlnmI), (D) SB3002 (ΔlnmJ), (E) SB3003 (ΔlnmG), (F) SB3004 (SB3003 harboring the lnmG overexpression plasmid of pBS3017), (G) SB3005 (SB3003 harboring the lnmG overexpression plasmid of pBS3018). (♦), LNM; and (∇), an unknown metabolite whose production is independent to LNM biosynthesis.

A PKS module cannot be functional unless its ACP domain is loaded with the extender unit, and this step is catalyzed by the cognate AT domain. Lack of AT domain in all modules of a type I PKS is unprecedented, raising the question of how the LnmIJ PKS modules are charged with the extender unit malonyl CoA for the biosynthesis of 1 (FIG. 11). Previously, we have demonstrated that lnmI is essential for 1 production, inactivation of which abolished 1 production (FIG. 12C). We similarly confirmed that lnmJ (SEQ ID NO 46) is essential for 1 production by replacing lnmJ with a mutant copy in which domains of PKS modules 7 and 8 were substituted with the apramycin resistance gene, aac3(IV). The resultant S. atroolovaceus SB3002 mutant strain lost its ability to produce 1 (FIG. 22D).

To inactivate lnmJ (SEQ ID NO 46), a 4,571-bp EcoRI-NotI internal fragment of lnmJ that harbors the KR and ACP domain of PKS module 7 and the KS domain of PKS module 8 was replaced with the aac(3)IV apramycin resistance gene and cloned into pSET151 (Bierman et al. Gene 116; 43 (1992)) to yield pBS3019. The latter was introduced into S. atroolivaceous S-140 by conjugation and selected for apramycin resistance and thiostrepton sensitive phenotype to isolate the double crossover mutant strain SB3002, whose genotype was confirmed by Southern analysis. To inactivate lnm G (SEQ ID NO 43), a 388-bp SalI-BamHI internal fragment of lnmG was replaced with the aac(3)IV apramycin resistance gene and cloned into pSET151 to yield pBS3020. The latter was similarly introduced into S. atroolivaceous S-140 to isolate the mutant strain SB3003, whose genotype was confirmed by Southern analysis.

To search for the missing AT activity, we re-examined genes within the lnm cluster and identified lnmG, the deduced product (the N-terminal half) of which is highly homologous to AT domains. We inactivated lnmG(SEQ ID NO 43) by replacing it with a mutant copy in which lnmG (SEQ ID NO 43) was disrupted by aac3(IV). The resultant S. atroolivaceus SB3003 mutant lost its ability to produce 1, confirming that lnmG is essential for 1 production (FIG. 12E). These results suggested that LnmG provides the AT activity in trans to LnmIJ and loads the malonyl CoA extender unit to all ACP domains of the six PKS modules for 1 biosynthesis.

Expression of lnm Genes in E. coli and Purification of the Resultant Recombinant Proteins.

Figure 13A:
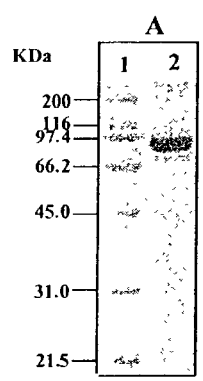
FIG. 13 depicts in vitro assays of LnmG-catalyzed loading of malonyl CoA to individual LnmIJ PKS ACP domains and the LnmJ-(DH-ACP-KR) tridomain protein. (A) Purified LnmG on 4–15% sodium dodecyl sulfate-polyacrylaminde gel (SDS-PAGE). Lane 1, molecular weight standards (MW Stds); lane 2, LnmG. (B) Purified LnmIJ ACPs and LnmP on 4–15% SDS-PAGE. Lane 1, MW Stds; lane 2, ACP3; lane 3 ACP4; lane 4, ACP5; lane 5, ACP6-1; lane 6, ACP6-2; lane 7, ACP7; lane 8, ACP8; lane 9, LnmP. The numbers after the ACPs refer to PKS modules from which they are derived with 6-1 and 6-2 to indicate the first and second ACPs, respectively, for PKS module 6. (C) Incubation of holo-ACPs or PCP with [2-$^{14}$C]malonyl CoA and LnmG as visualized on 4–15% SDS-PAGE (I) and by phosphor imaging (II). Lane 1, MW Stds; lanes 2 to 8; ACP3 to ACP8; lane 9, LnmP. (D) Time course of LnmG-catalyzed loading of [2-$^{14}$C]malonyl CoA to ACP3 as visualized on 4–15% SDS-PAGE (I) and by phosphor imaging (II). (E) HPLC analysis of LnmG-catalyzed loading of malonyl CoA to ACP3. I, a negative control in the absence of Svp; II, a negative control in the absence of LnmG; III, complete assay. (•), apo-ACP3; (V), holo-ACP3; (♦), malonyl-S-ACP3. F. Purified LnmJ-(DH-ACP-KR) on 9% SDS-PAGE. Lane 1, MW Stds, lane 2, LnmJ-(DH-ACP-KR). G. Incubation of holo-LnmJ-(DH-ACP-KR) with [2-$^{14}$C]malony CoA and LnmG as visualized on 9% SDS-PAGE (I) and by phosphor imaging (II). Lane 1, MW Stds, lane 2, a negative control in the absence of Svp; lanes 3–6, complete assay with incubation time of 2, 5, 15, and 60 min, respectively.
Figure 13B:
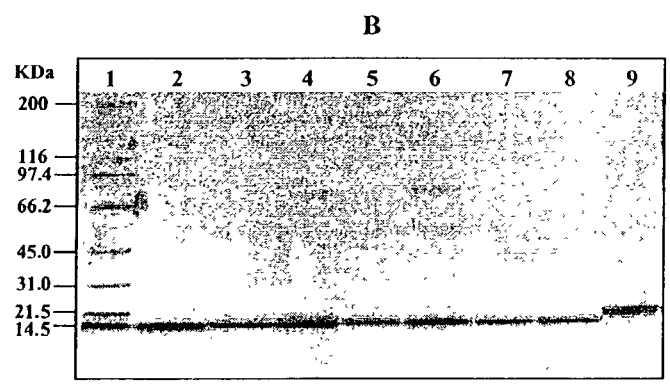

To validate the activity of LnmG, we expressed both lnmG (SEQ ID NO 43) and the seven ACP domains from the six PKS modules encoded by LnmIJ (SEQ ID NOs 45, 46) as well as lnmP (SEQ ID NO 52) in E. coli and purified the resultant LnmG (FIG. 13A), ACPs and LnmP PCP (FIG. 13B) as His$_6$-tagged fusion proteins to homogeneity. (We included the LnmP PCP as a negative control to demonstrate that LnmG discriminates the LnmIJ PKS ACPs from other carrier proteins.)

The lnmG gene (SEQ ID NO 43), the seven ACP domains from lnmI (SEQ ID NO 45) and lnmJ (SEQ ID NO 46), the tridomain PKS module 4 of lnmJ (SEQ ID NO 46)-(DH-ACP-KR), and the lnmP (SEQ ID NO 52) gene were all amplified by PCR with primers listed in Table 3 and cloned as NdeI-HindIII fragments into the same sites of pET28a (Novagen, Madison, Wis.), yielding expression constructs pBS3021 to pBS3030, respectively (Table 3). Sequence fidelity of PCR products was confirmed by DNA sequencing. Introduction of pBS3021 to pBS3030 into E. coli BL-21 (DE-3) resulted in the overproduction of these gene products as His$_6$-tagged fusion proteins, respectively. The latter were purified by affinity chromatography on Ni-NTA resin under the standard conditions recommended by Qiagen (Valencia, Calif.) and subsequently dialyzed against 25 mM Tris-HCl, pH 7.0 (for LnmG) or pH 8.0 (for ACPs or LnmP), 25 mM NaCl, 10% glycerol, and 2 mM DTT and stored at −80° C.

TABLE 3

Summary of Inm gene expression constructs

| Gene[1] | Primers[2] | Construct | SEQ ID NO |
|---|---|---|---|
| InmG | Forward: 5'>CGGAATTC <u>CATATG</u> GTG GCA CTG GTT TTC CCG>3' | pBS3021 | 230 |
| | Reverse: 5'>CGGCC <u>AAGCTT</u> CCC CCC GGC GAG GAC GTC>3' | | 231 |

TABLE 3-continued

Summary of Inm gene expression constructs

| Gene[1] | Primers[2] | Construct | SEQ ID NO |
|---|---|---|---|
| InmP | Forward: 5'>CGGAATTC CATATG TGG GAC CAC AAG TTC GAG >3' | pBS3022 | 232 |
| | Reverse: 5'>CGCGC AAGCTT TCG GCC GGC TCC GTC GAG >3' | | 233 |
| InmI-ACP3 | Forward: 5'>CGGAATTC CATATG TCA GTC ACC GGG CCG CCC >3' | pBS3023 | 234 |
| | Reverse: 5'>CGCGC AAGCTT CCC GAG GTC CGC CAG ATG >3' | | 235 |
| InmJ-ACP4 | Forward: 5'>CGGAATTC CATATG CCC CCG GAC GCG GTG CGC >3' | pBS3024 | 236 |
| | Reverse: 5'>CGCGC AAGCTT GAA CTC CCC GTA CAG GTG >3' | | 237 |
| InmJ-ACP5 | Forward: 5'>CGGAATTC CATATG GAC CCC CAG GAG GTC CTG >3' | pBS3025 | 238 |
| | Reverse: 5'>CGCGC AAGCTT GTG CAG TTC CCT GAC GTG >3' | | 239 |
| InmJ-ACP6-1 | Forward: 5'>CGGAATTC CATATG TCG CCC GAG GCC GTG CCC >3' | pBS3026 | 240 |
| | Reverse: 5'>CGCGC AAGCTT GTG TTC CTG CCC GAA GTA CC >3' | | 241 |
| InmJ-ACP6-2 | Forward: 5'>CGGAATTC CATATG TCC CCC GAG TCC CTG CCC >3' | pBS3027 | 242 |
| | Reverse: 5'>CGCGC AAGCTT GTG CTC GGC GCT CAG GTA C >3' | | 243 |
| InmJ-ACP7 | Forward: 5'>CGGAATTC CATATG CTG CCC GAG CTC GTG GAG >3' | pBS3028 | 244 |
| | Reverse: 5'>CGCGC AAGCTT ATG GTG CTG CGT CAG CTA CT >3' | | 245 |
| InmJ-ACP8 | Forward: 5'>CGGAATTC CATATG GCC GCC TCC ACC GTC GTC >3' | pBS3029 | 246 |
| | Reverse: 5'>CGCGC AAGCTT CAC CAC CCC CCC GAC CAA C >3' | | 247 |
| InmJ-(DH-ACP4-KR) | Forward: 5'>ATGAATT CATATG AAC CTC CCC TCC CCA C >3' | pBS3030 | 248 |
| | Reverse: 5'>AT AAGCTT GCC GTC CGG GGA GTC AGG >3' | | 249 |

[1]The numbers after each ACP refer to PKS modules from which they are derived with 6-1 and 6-2 to indicate the first and second ACP, respectively, for PKS module 6.
[2]The restriction sites (CATATG for NdeI and AAGCTT for HindIII) designed in primers are underlined.

Figure 13C:
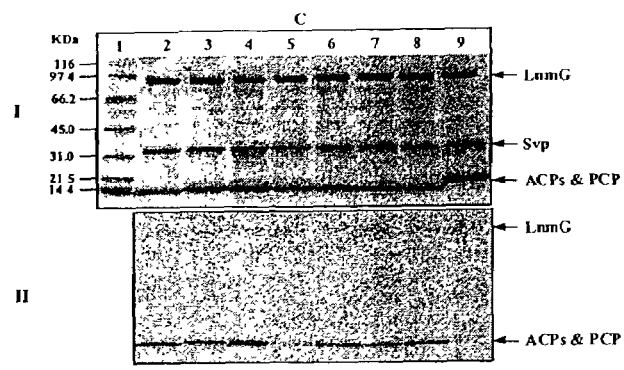
Figure 13D:
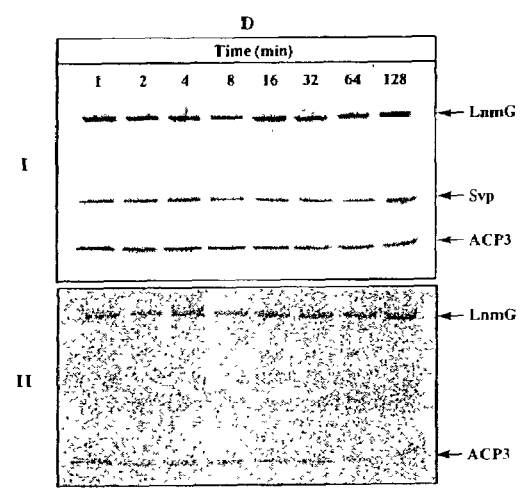

Since most ACPs or PCPs overproduced in *E. coli* are in the nonfunctional apo-forms, we incubated them with CoA and the Svp phosphopantetheinyl transferase to ensure that all carrier proteins are converted into the functional holo-forms (Walsh et al. Curr. Opin. Chem. Biol. 1:309 (1997); Sanchez et al. Chem. Biol. 8:725 (2001)). We incubated the holo-carrier proteins with [2-$^{14}$C]malonyl CoA and LnmG to directly test malonyl CoA extender unit loading. The reaction mixtures were subjected to SDS-polyacrylamide gel electrophoresis and phosphor imaging to detect specific loading of the [2-$^{14}$C]malonyl group to the phosphopantetheinyl group of ACPs (FIGS. 13C and 13D).

In Vitro Assay of LnmG with ACPs or PCP and [2-$^{14}$C] malonyl CoA.

LnmG-catalyzed loading of the malonyl group from malonyl CoA to ACPs or PCP was assayed in a two-step reaction. First, the phosphopantetheinylation of apo-ACPs or PCP was catalyzed by Svp in the presence of CoA (Sanchez et al. Chem. Biol. 8:725 (2001)). A typical reaction of 75 µl contained 100 mM Tris-HCl, pH 7.5, 12.5 mM MgCl$_2$, 2.5 mM DTT, 33.3 µM CoA, 10 µM ACP or PCP, and 2 µM Svp and incubated at 25° C. for 60 min. Second, a mixture of 2 µM LnmG and 10 µl of [2-$^{14}$C]malonyl CoA (200 µM, 51 mCi/mmol, PerkinElmer, Boston, Mass.) in 15 µl volume was added to each reaction. Reaction was incubated at 25° C. and subsequently quenched by addition of 900 µl acetone at various time points. Proteins were precipitated by centrifugation at 4° C. for 30 min after frozen at −80° C. for at least 1 hour. Protein pellet was re-dissolved in 1× sampler buffer and separated on 4–15% SDS-PAGE gels (Bio-Rad, Richmond, Calif.). The resolved gels were visualized by Coomassie blue staining and phosphor imaging (LE phosphor screen, Amersham Pharmacia, Piscataway, N.J.).

Alternatively, the reaction mixtures were subjected to high performance liquid chromatography species were purified and subjected to electrospray ionization-mass spectrometry (ESI-MS) analysis (Table 4). For HPLC preparation of apo-, holo- and malonyl-ACPs, the phosphopantetheinylation reaction or complete loading reaction was scaled up 3 times and cold malonyl CoA was used instead. The second step of loading the malonyl group to holo-ACP was proceeded for 10 min at 25° C. HPLC analysis were carried out on a Jupiter C-18 column (5µ, 300 Å, 250×4.6 mm, Phenomonex, Torrance, Calif.), eluted with a gradient from 85% buffer A (H$_2$O+0.1% TFA) to 90% buffer B (acetonitrile+0.1% TFA) in 25 min at a flow rate of 1 ml/min and UV detection at 220 nm to separate the proteins in the reaction mixture. Individual protein peaks were collected manually, lyophilized and re-dissolved in H₂O for MS analysis. ESI-MS analyses were performed on an Agilent 1000 HPLC-MSD SL instrument (Palo Alto, Calif.).

Figure 13E:
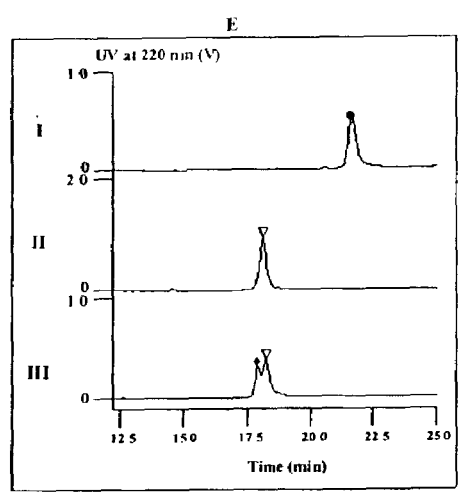

LnmG specifically and efficiently catalyzes the loading of the malonyl CoA extender unit to the LnmIJ PKS ACPs, and no loading was observed in the absence of LnmG. After 5 minute incubation in the presence of LnmG and [2-$^{14}$C] malonyl CoA, six of the seven ACPs were efficiently loaded with the malonyl group (FIG. 13C, lanes 2–4 and 6–8) with ACP6-1 being loaded less efficiently (FIG. 13C, lane 5), and no loading was observed for the LnmP PCP (FIG. 13C, lane 9). [The observation that ACP6-1 is less efficiently loaded is consistent with the finding that PKS module-6 has two ACP domains, one of which may be the preferred site for malonyl CoA loading (FIG. 11).] LnmG was also labeled by [2-$^{14}$C] malonyl CoA (FIGS. 13C, 13D, and 13G). Acyltransferases are known to form acyl-O-enzyme intermediates at their active site Ser residues before transferring the acyl groups from their CoA substrates to the nucleophilic recipients such as an ACP, and labeling of acyltransferases by extender units has been confirmed for both the AT domain of type I PKS (Marsden et al. Science 263:378 (1994)) and the malonyl CoA:ACP transacylase of type II PKS (Carreras et al. Biochemistry 37:2084 (1998)). Interestingly, the extent of ACP labeling decreased with longer incubation time— reaching a maximum in the first 5 minutes and falling to less than 10% after about 2 hours as exemplified by LnmI ACP3 (FIG. 13D). The malonyl-S-ACP product is apparently not stable under the assay condition, the malonyl group of which undergoes hydrolysis in the absence of chain elongation. Analogous results have been found for both the DEBS PKS (Marsden et al. (1994)) and fatty acid synthase (Wakli, S. J. Biochemistry 28:4523 (1989)). In contrast, LnmG labeling appeared to be constant (FIG. 13D), suggesting that the malonyl-O-LnmG species is stable under the assay condition. To exclude any ambiguity associated with these assays, we subsequently purified the apo-, holo-, and malonyl-S-ACP species from the assay mixtures by HPLC, as exemplified by the LnmI-ACP3 (FIG. 13E), and established their identities by ESI-MS analysis. As summarized in Table 4, distinct [M+H]⁺ ions at m/z values exact or near the calculated values of the corresponding ACP species were observed for all samples analyzed, confirming their predicted molecular structures.

TABLE 4

ESI-MS analysis of apo-, halo-, and malonyl-S-ACPs

| ACPs[1] | apo-ACP [M + H]⁺ | | holo-ACP [M + H]⁺ | | malonyl-S-ACP [M + H]⁺ | |
|---|---|---|---|---|---|---|
| | Calcd. | Found | Calcd. | Found | Calcd. | Found |
| LnmI-ACP3 | 11,702 | 11,700 | 12,042 | 12,040 | 12,128 | 12,126 |
| LnmJ-ACP4 | 12,245 | 12,241 | 12,585 | 12,582 | 12,671 | 12,669 |
| LnmJ-ACP5 | 12,520 | 12,517 | 12,860 | 12,857 | 12,946 | 12,943 |
| LnmJ-ACP6-1 | 12,209 | 12,206 | 12,549 | 12,546 | 12,635 | 12,632 |
| LnmJ-ACP6-2 | 12,151 | 12,147 | 12,491 | 12,486 | 12,577 | 12,572 |
| LnmJ-ACP-7 | 12,322 | 12,318 | 12,662 | 12,665 | 12,748 | 12,751 |
| LnmJ-ACP-8 | 12,090 | 12,087 | 12,430 | 12,427 | 12,516 | 12,512 |

[1] The numbers after ACPs refer to PKS modules from which they are derived with 6-1 and 6-2 to indicate the first and second ACPs, respectively, for PKS module 6.

Figure 13F:
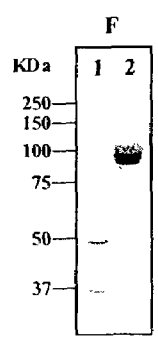
Figure 13G:
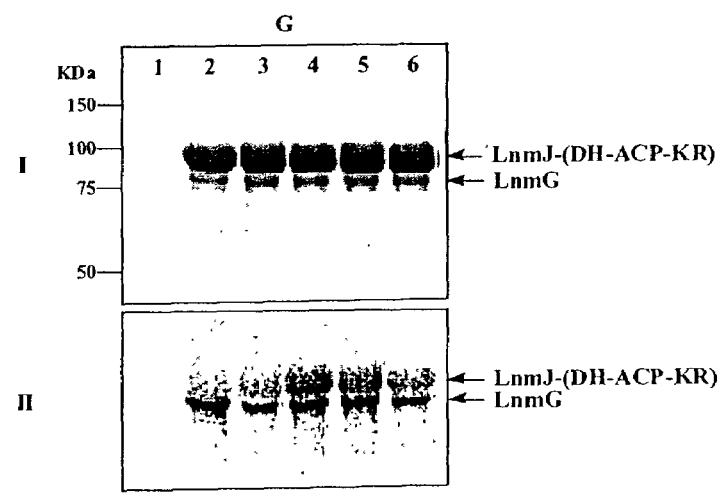

Finally, we expressed the PKS module 4 as a tridomain protein, LnmJ-(DH-ACP-KR), in *E. coli* and purified it as a His₆-tagged fusion protein (FIG. 13F). LnmJ-(DH-ACP-KR) was similarly assayed in the presence of LnmG and [2-$^{14}$C]malonyl CoA to confirm that LnmG can load the malonyl group to a multi-domain PKS module as efficiently as to individual ACP domains. As summarized in FIG. 13G, LnmG efficiently loaded the malonyl group to holo-LnmJ-(DH-ACP-KR) (lanes 3–6); the extend of [2-$^{14}$C]malonyl labeling reached maximum in 5 min (lane 4) and decreased with longer incubation time as a result of hydrolysis (lanes 4–6), and no loading was observed with the apo-LnmJ-(DH-ACP-KR) protein (lane 2).

Yield Improvement by Overexpression of LnmG

Given the mechanism that LnmG is responsible for the loading of the malonyl CoA extender unit to all six PKS modules of the Lnm NRPS-PKS megasynthetase, we reasoned that LnmG could be a rate-limiting factor for 1 biosynthesis. We therefore explored yield improvement for 1 by overexpressing lnmG under the constitutive ErmE* promoter in both low- and high-copy-number vectors in *S. atroolivaceus* SB3003 (Kieser et al., Practical *Streptomyces* Genetics (The John Innes Foundation) Horwich 2000). To construct the lnmG overexpression constructs, a 450-bp EcoRI-SacI fragment that harbors the ErmE* fragment (Ribb et al., Mol. Microbial. 14:533 (1994)) and a 2,883-bp SacI-BglII fragment of the lnmG gene were cloned into pBS3031 [a low-copy-number vector derived from the SCP2* origin of replicon (Kieser et al. (2000)) and pBS3032 [a high-copy-number vector derived from the pIJ101] vectors, respectively, to yield pBS3017 and pBS3018. The latter were introduced into *S. atroolivaceus* SB3003 by conjugation, and the resultant SB3004 and SB3005 strains that harbor pBS3017 and pBS3018, respectively, were cultured and analyzed by HPLC for LNM production as described previously with the *S. atroolivaceus* S-140 wild-type strain as a control). The resultant recombinant strains SB3004, harboring the low-copy-number expression construct pBS3017, and SB3005, harboring the high-copy-number expression construct pBS3018, produce 3–5 folds more 1 (FIGS. 12F and 12G) than the wild-type S-140 strain (FIG. 12B) as determined by HPLC analysis.

It is understood that this invention is not limited to the particular methodology, protocols, cell lines, vectors, and reagents described, as these may vary. It is also to be understood that the terminology used herein is for the purpose of describing particular embodiments only, and is not intended to limit the scope of the present invention which will be limited only by the appended claims.

It must be noted that as used herein and in the appended claims, the singular forms "a", "an", and "the" include plural reference unless the context clearly dictates otherwise. Thus, for example, reference to "a cell" includes a plurality of such cells, reference to the "vector" is a reference to one or more vectors and equivalents thereof known to those skilled in the art, and so forth.

Unless defined otherwise, all technical and scientific terms used herein have the same meanings as commonly understood by one of ordinary skill in the art to which this invention belongs. Although any methods and materials similar or equivalent to those described herein can be used in the practice or testing of the present invention. All patents, patent applications and publications mentioned herein are incorporated herein by reference for the purpose of describing and disclosing the polypeptides, polynucleotides, cell lines, vectors, and methodologies which are reported in the publications which might be used in connection with the invention. Nothing herein is to be construed as an admission that the invention is not entitled to antedate such disclosure by virtue of prior invention.

SEQUENCE LISTING (265 sequences)

SEQ ID NO: 1 - DNA, 135638 bp, Streptomyces atroolivaceus
cgaagcggaagcgcccaggtcagtctggctgtagcggcggcccaggtgaacagtgcatctcgactgcgacgagccgtcattgaccgtggttgaccgcacgatgtggcacggctgtggcacacgaccgcttcgtcccgaagcaactcggggcgctcgctgtccttgggctgctgcgcctgtcaccggcgctgatggtccgctgacgtccacggttgttcgtggttgtgcgtcgcggttgtcacgcagctggacactcaccactactactgtccgtgtgaggcccgaaaggttctcgtaaatgatcttcgaccggtgtcgaccgcctagtgcgaggcgaagatcgcctgatgcccgatcgtgatccaagggtgtacaaccccgtgcggatcccaactgtctgaagggcgccggaggatgagcctccggcgctcttccgtacggagatcggggatcaggtggggaagaagatctggagagctgtcgcggccggtggcgcggcggcggtgttcacggccatggccgcgggaccggccggggcggccgagggcggggtctcgttcacccgtgtccaggtgaacggcggcaaggcgatcgtgattggggtgtcgaacgaggtcgcggtgcccacatccttccggatggcgaccacacaccagtggaagtggccggcggtgttcctgtaccgcggcaagacgagtgagcggctgtggcacgcgatcgagacgagcgactgcatcaaggtgagctcgggcgtctgtgacttcaacgagacgatgtacttcgacccgagcgagtgggagatgcgcaacagcgaggccggggcgtggaaggtcgcggccgaggtctacttccagggcggcggcggcgacaccgatgacgagggcctcacggcctacgtcaagcgcaactcccacctgaccgtgaacgcctcgcccgaaccggtggccaaggacaagaccatcaccgtgaccggcaaggtcacgcgggccaactgggagaccaggaagtacgtctcctacgaaggccgcctggtgaccctgcagttcaagcccaccggaaccacctcctacaccacggtgaagaaggtgtacgcgaacggctcgggcaacctcaagacgaccgtgaaggcatccaagacgggcacatggcgctgggtgtactacggcaacaccactaccgggccgtcgacttcggccggcgacaatgtcgtagtgaagtgagttccctggactgcctctcgacctactcggcacagctacaggacaacctttaggctcggcttcgcgcggtcggcggcgaggtatccagctctgaagtgcagctgcatccctgattctgtctaggggtggtccggtatccaatccgtggcccaaccgacctccaggcctagttgatagctatgagggggacctgtcagcgccgaccccgcacaagccctgaacggtcttgaaaaccgtcgtggcgcaagtcgctttgggttcaaatcccacacccaccgccaggagaaacggcccctgaccaggcattttcagtcaagggccgttctgctgtccactccccgccagtgactgccattccccgggtgatcgggcacgagaggggcacggctaccttctgatccgtagctctatatagatcggtcagcgacagtcattccggtcgcttcacggcccaggagagacgcaaccggtcgggggcggccgatggggttgaggtacttcgctgctgtacgccgccccgggagacgaccccgagtgcgagcaggtctactctcctcggatggacgacgcccctttcttcgcctcctgccgggccgtcgcacggctggcacccagctaaccatccacaccaccggagatcgtttgggtccgctccacgaaaaggcggaagtcttccagaggtgcaggtcgcagtggggcggtcacttcaggctgtaacgcgtgttcctggtctcggagggggccagactaggccgcacctggtgtgcttggcttgattaaagccacgaacgtaccccgctttcataccggcgagccaacctttattgtaggcctcgaccctagcctggtcagtctcgttttcattttccagctgacgtccgcacccggcgtcgaagccgcggctgaaaccgtgagcgtcgccctcaaagtatccttcgttgtagtcagttatgtatttgttctcagttatgtatgggcacttcgcaccagcgggggcagcgcaaggtctcgaccagggtgctgcggacgcctgagtgatgacatgaggagataaagcgagagtagccgcaacgagcgctggactgagccgaatgaatagtcgtctggcatccatggttctccccttggaccaactcggctttggggcggcgatcgtctggctgtcatcgacgccaggtcgccgcctctaatcgatcgcgaggttccacctctactgctgttcccatggtgcgcttcagccccaaggctgtcatctcgtgttgaatcaaccgctgtgagggccgaaagcctccgccgtccgcgcacgcataccggcaagacgggtgattcgtgataccacaccgcgccacgcccctcaacgcgcagtgccggacgcacgagcccatcgcgattcacaacaaatggcctatcagagtctcgaagacgtccggccatcctgcggccgttcttgtatccgggcactcactccgaagccatggcaaacgcccggatcaagtgggaggccgtacaccactcctcaggacgcaacccggccttgaaaaccgtcctggcgcgagtcaccgtgggttcaaatcccacacccaccgcgcaggttgaaggcccctgaccagcaacattggtcgggggccttcgctttacacgctgtccgtgagtgaccgtcgctccccggtgttccccgctcgatcgggcacgccgggggcacggtcagtcttcgacgggactgggcgccgtgaggtcaatccatatccacggcttgtgatcccagtcgcgcaccttgcctatgactaggtcgacggtcgcccccaccggcggcagctcctgcacgagtcgcttcacgcccggctcgcttctgcggcgaatcgtgtccagcgaggcgcccacggggtcgtactcgttgagctttgccatgaggccccatggctcgtgactagtgatcgttgcttggactgtctcgccttgctgaagctcgctgagagggcgtctcggtttagacgctatctcccgttccgggcggttcgcggtccgattcggagagtgcgtacaagaaggcaaatcccttgcccttaagtcgctcgcgtcacgttgccttgtgctgacactcttcgacctggacaacaccctgatcgaccggcacaggccttgagtactgggctcgtgacttcgtccgctggcgctctctgcctcaagaggcggaggcagccatccggccgggcctccccgcagccccatgctgcagacatctgaagcggaaactgaggagaccaccgaatggagatgtccgacacctcgcgtgcgatcgctgctgcgatttcgattgccgcatctctcggcctgccggccgatgacgcgatcgttctccacaactcgaacaagctggcactgcggctgacgccgagcgatgtccttgcccgggtcgcccctgtgggacaagaggttgcacacttcgaagtcgagctcgctcaaaggctcgccgagttcggatctccggtgggcctcctggaacctcgggtggacccgcgtgtgtacacgcgcgacggcttcgccgtgacgctgtggacctactacgagcccgtgacacctcacgtctcaccagccgactacgccgaggcgctggagcgactgcacgctggcatgcgcaaggtcgatgtgccgagcccgagcttcatggagcggatcacggaggcgcaagaagtcgttgccagcctggatctctcgccggggctagccgacgcagaccgtgtgctcctcagcggcaggctgggaagcctgcgacgggcgatcgagggccgcggcgcggtggagcagttgctccacggcgagccgcatccgggcaatgtgctcagcacgaagaagggcccgttgttcatcgacctggagacgtgctgccgtggtcccgtcgagttcgacctcgcccacgctcccgaggaggtctgcaagcactaccccaacgtcgaccaagggctgctcgatgactgccgacagctcgtcctcgcgatgctcgcagcatggcgttgggagctcggcgaccagttcccgaacgggaagcgattcggggaagaatttctccgcttgctgcgagagggcccaccctggccgaccttcgacgcagtgaccaggcgactgggcagcggccagtagaaatcaccaatgtggcacgaccgggatcaccgccatcgtccgagccgtcatcgttcttgaacatgccagctgggcaagatggaaaggcccagtggctcagacttccggcgggattgccagcatctgatccgtaggcgggtgcgcgcacggatcgcctgaactcccctagccatcagggtctgttggtcaggggtcacctgtacatcgacatgtgcatgtgtgcgccgacgttggtgtccgacagcggcgcttccgaagggtcgggcacttgaggctgggccacgccccacccctcaacagggtgacctgggaaatcccttggctcggaccaccgcttcaggagttcgatccgaagggccacgctgggccgatagccaacttggcagccacgtcgaaggccgcggttggccactgctgttcgttggcgttgatgtcagacacagatgtcggtaagcctcactaccagcccccgtcgaaccgaggttgcagggtggccgccacgcccgacgtgacagcgagtatgccgcccgggccggccagggtggtcgtctcgcgttccggaacaactcgtgctggagcgtcggcgaagtcgatgcacgacgccgggagctgcggcgtcaggcaccttggcggtggtgccgagcgtgtcgcaagagacccctgcgatcacccttgctaccgtccacctcgcctaaataatccacaattgaccgattcgcacccgcgggtgttgcgagaggacacggaccatgagcgacttttcccgccgccgactgctgaagacttccgcggtcgccggcgccggcgcagtcgtcgtgccgggcgtcgcggcagccgcgacccctagtgcgggtgtcgtgacggaggcttccgtaaatgaggcgtacgaggcgcagtgttcgccggcgaagctgaccggccgcatcgtccgtccccacgaccctgggtacacggatgcgcgcctcggctgggaccagctcttctctcactatccgctggtcatcgtcttcgctcagaacacccaggacgtggtcaacgccctgacctgggcgcggcagaatgatgtcgcgctgcgaatccggagcggccgccacagcctagagggctggtcgaacgtcgacagcggcctcgtgatcgacatcagcgaactgaagtcggtccatctcgacagcgctgctcgtgtcgcgacggtcggcgccggactcaaccagctggaagcggtgaccacgctcgcgaagcggaacttcgcggtgacgacaggcaccgaaggcacggtgggcctggccggcgcgacgctcggtggcggcttcggcttcctgacgcgctggctggggatggcgtgcgacagcctgatcggcgccgaggtcgtggtggccgaaggcggcgagtgcgcaaaggtgatcaaggccgatctgacccataactcggacttgttgtgggcgctgcgcggtgcgggcaacggcaacttcgggatcgtcacctcactcacctacaaggtggctccactgaagagcgttacgtatgtgcaggccacgtgggatggcatcggtgacctgcggagggtcttcaatgcctggcagcgcaccgcgctgcacgccgatgaccgccttggcacgcaggtcgaaatccaccgcaatcagaccttgttgttcgcggtcctcgcggaggggacacctgcggaggccaagaagctactggccccgatcctgtcggtcggcagcccccaggtgtcggtgcaggttggcaactggggcgaggtgtattcgggattccagattcctaccgcgaacgaacccgcgaactggaagttctactcgcagttcaccaggaagccgttcccgggcaaagcgatcgacgtgatctgctcgttcatgaagcacgcgcccacggacgacagcaacttcttcactcaggcgttcggtggggcggtcagaaggagtccccgcggcggcacggcgttcccgcatcgcgacgcactcttctactccgaacccggtgccggctggggaacccgttccgaccagccgggcatctgcgacccgctcaccccgcaggcgcaagcctggatcgccgagttcagccaggccttgcgcccctacgtggacggtgcctacgtcaacgtgccgaacgtcggcatgcaggactgggaaaccgcctactggaggggcaacttcgaccgcctgcgcgagatcaaggcgaagtacgacccgcacaacgtcttccagtacgaccagagcatcccgcctgcgtcccgctgaccgaacttgatggagccccctcccgaccggtgagggggctccgctgcgcctacccgtctcaggcctttcgctcaagagagccggactttgatgcggttcgacaatccgtggccggagcgcccctttctcgacgatcagccgatcccgcacgccatttggggactggtcggaggagcccaccggctgctggccggtccttggggtgcggatgtggtgcgctctcctttgcgcgctggcgaccactgagccgtggccctccgccgtacagacggggtccggtggggactactcaggacgccgatcgcgcgccacgctcgtacggccaccccgcgagcgcctcttgctcccaccggttcggcttgcgcctcgggcgcccccgggcacctgttgtcgggacggccgactctatggccgcagggaactacggccaagcgcttaccagtgcggggggggcgagggcacgcgctgagtgacggcgagtgtgtaccggccgtggggctgtcgcccctgcgggaacgcccatcgcccatcgatgacgtgagagcgcgggcccgccgcacctggcgtccgcccggcggaggccatgcgccaagccgccgaccgggatgccccacaggcccgttgcgccgtccctcagcacgccgaattcatgggcggtccgcccacccggacgcgcggtggccgacgcccccgtctgctcgtggcgtaactgtgacatggcacaagagcgacatgtgcgaccccttgaacgacggcgggggaggccggaggatccagtgatctttcgctcttcgccgcgtctcaggagtcttccttgcccaagcttcccatcccccggcccgggccgatcgccctcgccgtggcggccgcgctgacactcggcgtcataccggcgactgccgctgtgtccgcgtactcgtccggtgaggtgtcgcacaacgacgccggacaccgaacccccggcgatgccggcacgcacaccgtcaccctgatcacgggtgacaaggtcaccatcgggaccgccgccgacggcaccgtcgtgcgctccttccgggccgcgagcggagccaccaccggcttccaccgcgctgtcgtggacggcgccacctatgtctaccccgacgccgccctcccgtacgtgagcgccggcaaactcgacaagcagctcttcaacgtgacgcgcctgatcaccgagggttacgacgacgcgcacagctcccggctgccgctgatcgtgcgctacaccggagccgccgccaaggcccgcacccggacgaagatggccggctcgaccgacgtccgccgcctggacagcatccagggcgcggccctcgcgcagaaccacaagcaggcaccggagttctggtcctcgctcaccgggggctccggcgcggcggcccggtccgcgaagccctccttcgcgggcggcgtcgcccacgtgtggctcgacggcagggtgaaggccgatctggccgactccaccgcccagatcggcgcgcagaaggtatgggcggagggcgacaccggccaggacgtgaaggtcgcgatgctcgacagcggcgcggacaccgaacacccggacctggtcgggcaggtgtccgacagcgccagcttcgtccccggcgaggacgacatcgccgactacaacggccacggcacgcacgtcgcctcgaccatcgtcggcacgggcagcgcctccgacggcaaggagcggggtgtcgcctccggcgcccggctgtccgtcggcaaggtgctcaactccgagggcagcggccaggaatcgtggatcatcgcgggcatggagtgggccgcccgcgaccagaaggccaggatcatcagcatgagcctgggcggcggcggtgacaagaacgacccgatgagccaggccgtcgacgaactcagccacgacacgggcgcgttgttcgtgatcgcggcgggcaacggcggcccgcactccatcagcagccccggtgcggcagactccgcgctgaccgtcggcgccgtcgactccaccgacacgctcgccgacttctccagccagggcccgcgtgacggcgacggcgggctgaagccggagatcaccgcgcccggcgtcgacatcgtcgcggcgcgctcgcactacaagcgcggctccggctactacaccacgatgagcggcacgtcgatggcgacgccgcacgtcgccggtgtcgccgcgctcctcgccgccgagcaccccgactggacgggcacccagctcaaggaggcactggtcagcagcgccaaggcaacgccggcgtacaccccgtaccaggcgggcgccggccggctcgacgcgccggcggccgtgcacaccacggtcttcgccaccacgaccgcctactccggcttccacacgtggcccccgaagcccggggagaccgatgtccggacggtgacgtacaccaacgtcggcgacgccccggtcagcctcaacctggccgtcaacggcaccgtcccggccgggttgttcagcctctccgaggaccatgtcaccgtgcccgcgcacggcaccgccacggtcaccctgaccgcggctctggacaagctggcgggcgaccagtcggtcagcgccgtgatcaccggtacggacggcagcggagcggtccgtgcccggactctgatcggcgcggcccgagagggccagcggcagaatctgaccgtcgtcgcgaaggaccgtgcgggcaagcccctggcgggccgggtcgtcctcaccgccgagcacctcttcacggtgatggacctcgacgcgtccggcaccggcacgacgcggctgcccgtcggcagctacagcggctggctcaccggggacgtgcagggcgccgaaggcccgaactcgctcggcatggtgctgctcgccttcaacgacgtgaagctggaccaggaccgcaccgtcacgctggacggccgcaaggcgcgccggatcctggcgcgcgtgccgcagcagaccaccgccgtcgcgccgcgcctggacgcccaccggtccttcaccgacagcctggtggagacgtcgatgctgcccaactcgtcgtacgacagcatctgggcgctcccgaccggcaagaaggtcaccgacggcgagttcgaggccggcgcccgcttccgcctcgagcagccggcgctgaccttgaacacgaagtcgacgaccttcaacgacccgttggtcaagcgcgcggccacgccgctgcccgccggtagccggaacctgacggcggtcttcgccggcgacggcacggccgaggagctcgcgcggcagaacgtgcgcggcaaggccgtcgtggtgcggggcgccggcacggaagggatcaaggcgcaggcggaggccgccgcggcggccggcgcccggctgctgctggtcgtcaacgacggcgtcggccgcctgcagccctgggtcgagaacccctggagcccgcagagcccggccccggtgacggtggcgacgctcaccgccgaccagggcgcggagctgatcggctcgctccggcacggcgcggtgtcgctgaaggtcacctcgcaccccacgacggactacgtctacgacgtggtgcaccactggaccggcgccgtcccggcggacccgacctggcgtgaggagtccaaggacctcggccgggtgaacgtctccttccggaactaccgtcagggcaaggcgatggagttccgtccggacgtctggcgcggctgggccgtcggtaaccagctcacggcgcccgcccagggcgagcgcaccgactgggtcacctccggcaccacgtggctggacgacgccttcatccagggcgagaccgggcagcactcgatcgacccgctgcagtactcggcgcgcaagaccggcaaggtcaactggttcggcccgatccagcggccccgcatgggcccggtgaactaccagcccgtgcgctacctcgacacgatgtacatcaccgcgcccggctggggcgactcgggctccggccacgtcggcgaggccggcgcgaacttcgacgtcaaggactggatgtcgctctaccagggcgaccagcagctcgactggggcaacgccgagtatctgcaggttcccgggctcggtgcggagcgcctgccctaccggctggtcctcgacaacaaccgtggcgcctgggccaacccgtactcgacgcacacgctgaccgagtggaacttcacctctgcggtcaccagcagccagtcggcggtgtcactgccgctgatccagctcgactacggcgtggacaccgacaagtccggccgggccgaccggcatgccgggctgacggtgaccgcatcgcacctgcccggcaccactgccgcgatcgcgaagccgtccgtcgaggtctcgtacgacgacggtgcgacctggcagcggaccggcctgagccggtgcggtgacggatggcggacgaacctgcgagccccgcggtcggccggcttcgccaccctccgggtcggcgcccgggacaacgcgggcaacaccgtctcgcagacgatcacccgggccttcggcctgcgctgacgtcacaacccgggaggtcacctgggacagcaccgtgtgggtgggaccgcagccggcggccccacccacacggcattcccagtcgtcagaggatctatgaggacaccccgtcgcggaacggcaagcgagtgctcgtggatcgcctgtggccccgcggaatgagcaaagcgcgggcccacctggacgaatggatccgcgacgtggcgccgccggcggcaggtcggccaagtgcttcgctgctgccggagacgtggcggccgacgcgcgccaggcgcgtccccggccagaccattcgtacagccgccggattcaccacgcactccgcatgcacccgttcaggcgcagccggcgagggcgtcgatcgcttccttcccgtggtgagtccggccggttgggtcgggtcactcgggtccgccgagcgggagcgtcggcgttccgccctctcgcaggcggtggtgagcgactccatggggtgcggggtctgcacgaagaccccgcgttccgggtcgaggccgacactctggccgtactcaccgactcgtagaccggttggctctctgcgcctcttcgggatgtgtcgcgcatcacatccggcccctgtcacgtccaagccgcctgctcccatcttgtgggcgtcagtgagcgaggcgaggaggacggaacgatgagcgcacggcaggagaccagcacggcgaccgcgcaccacgtggtgatcctgggggcggggtacgcgggcatgtccgccgcgatccagctcgcggcccgggtcaaggggcgcgaggacgtacaggtgaccgtggtgaatgcgcaggagcggttcaccgagcggatgcgtctgcacctgacggcgaccggccagcggctcgccgagctgagcatcccggaactgctggagggcacggaggcacggttcgtgcgcggctgggtgacggcggtggacgcggacgccaagaccgtgcggatcgacgacgaccgggtgctgccctacgacacgctggtatacgggttgggcggggtggccgacacgtgcacggtgccgggtgtcgaggaccacgcgtacaccctgagcagtgcgcaggacgccgagttgctggccgtccggcttgggcgtctcggcagcggcaccgtggtggtcgcgggcagcgggctgaccggcgtcgagtctgctgcggagatcgccgagcggcacccggagctggacgtcgtgctgctgggccgggccgagcccggcgcgaccatgaaccccaaggccaaggcgtacgtgcaggccgcgctcgaccggctgggcgtccgggtgcgtgccggggccgaggtggtgaaggtgctgtccgacacggtcgaactggcgggtggggagagcatcgccgccgacgtggtcctgtggacgagcggtacgcgcgcgtcgccgctggcggctgccgccgggctggccgtcgatgagcgcggacgcatcgtcaccgacgccgcgctgcggtcggtgtcccaccctgacgtgtacgcagtcggtgacgcggccgcgatccgccagggctacggcgtaatgcacggcacctgccagggcggcatgccgaccggggtgcacgccgcgctgtcgatcgagtgtgtgctcaagggcaagcagcccaagccgttccgcttcggttactaccacacgccggtgagcctggggcgaggcgacgcggtggtgcagttcacccaccccgacgacagcccgcgccgaatctgcctgaccggacgcatggcggtcaggtacaaggagatggtgactgcctccccttggccgacctacggccgcatgaagaagatgcccgcctccggcgcgttctggccccgcgggggccgctccgcccgggtccgggaggcacggtgaccgacccgaccgcccaccccggccagcaggccttccacgagtaccgcaagctgctgttctccgtggcctaccgcctcctcggcaccgcggccgacgccgaggacgtggtccaggacgcctggatcaagtggtccgctgcggaccgttcgcaggtggccgaccccagggcgtatctgacgcggatcgtctcgaacctggcactggaacggctgcgctccactcggcacaagcgggagacctacatggggccgtggctgccggagcccatactcaccggcggggacgcctccgaggccgtcacggaggccgagtcggtgtcgatggccatgctggtggtgctggagacgctcagccccctcgaacgcgcggtgttcgtgctgaaggaagtcttcgacttcagccacgccgagatcgcggaggcggtggagcgttccgaggccgcagtacggcaggccgcgcaccgtgctcgtgagcatgtgcgggcccggcggccgcgtttcgccacggaccggtcgcggcagtgcgaggtgaccgagcggttcttcgccgcagcgaccggtggtgacatcaacaccctgatggaactgttgtcgccggacgtcacgctgtggaccgacggcggcggcaaggtccgccaggccatgcgtccggttgtgggcgcggccacggtggccgcttggttcgcggccatcggcaccgttgcctaccagggcgtcgagcccgccgacatgaaagccgaactcgtcgagatcaacggcggcccgggcatggtgttcagcggactgggccgtgtgatcgccaccgtcaccttcgacttcgacgccaacggccgcatcaccgccatccacaacgtcgccaaccccgacaaactccaggccattgccgacgggacagctcgcgacgtcgggacgcgctgagacctgcgcgggatcgccgcggcccgttgggcgagatcgtcgcccaacagcccgaacgcaatcccgagccacccacccacgacccggccggcccaggcgcagtcaccggcggtcgaagcgcggggcgacaacacgacgcctcggaatgaaacaggaggagccagaccaagacacccatgccatcactgttcccgcatcacagaacacgtcagccccaacagccccgtccaaccgcaagcggatatcggcccgaacggggctaatgcagagccaagatccctctgcgtgcgtgcttctgatcccagggatctggcctgcggtgatcgataggttgtacgcatggttgcgaacgagggtgtggccgtcgtcggggcggacgtcgatgaccgaggctggtccgacacgcgggcttgggtggaaaagcgtgtaggcggagggtgccgcatcgacgctgccgagcggctgcgtggcggatggacttcggagatgcggcgtctacgcactggcggaacgggagagccgcagtggatggtgctgcggtcgttcgtgaagccattcttcgttcagcatgcgaagggactgctcactcgcgaagcggaaatcctgcgtctgctcagcgagaccgatgtgccggtggcggagttccacggtgtggatgcgacggcggtgtactgcgaccacccgtcgttgctgatgtcgctgctgcccggcagtgtgcggttgggtgaggaggaagcggggctgcggtcccagctgctggcccgccaactcgtcggcattcaccaggtgcgggtcccggtcgaggcccggccgcgcgtttaccaggcctggacgtcgcccgaccgtgtgcggctgcccgaatccaccgagcggctggacttgtggcagcgggctgtggacatcatccggcgcgatccccctgactaccggccttgcttcctgcaccgggatttccaccccggcaacgtgctcttcaccgggcagggcgcccgttcggagatcaccggtgtcgttgactgggtggaggcgtcctggggcccggcggatctggacgtggcgcactgttccacggccctggctctcctgcacggcgccgaggagggcatgcgcctggctgatctctatctggcttccgggggcacgttgagtgaggacccggccgctcacctgtactggcgcgtcctggatgcactcgcgttcgcaccggatgccgagaaggtcgcggtgccctggcgcgaactgggacgcaaagacctgacttcggacctgctcaccagcaggctggaggaataccttgaggagctcttccgccgcttcggctgatcgtctccacctggcggggcctgggcagcagactgagccacggcccgggaacggccgcgcgagcggtgaacagtggcctggccggctttgacggctcagctggaggactcgtctttcttgcccaactgccggtgcgcgggcccttcttgtccaactgcccgtgcgggggcctttcttgtccaactgtcggcgtgcgggcctttgcgggcgaggcggcgggtcatgagggtgaagagtgaccaggtcacgtgggcttcgctgcgctgcggggaggcgttcgtagccccttgcgttgcggcgggcgcgcaaggtccagccgatcgtgcgctcgacgcgccggcgaggctcccccggcgccccgcaccgcggccgctcggtggtgacacgtgggcgacggcctgacccctacccgtcggccggccttcgtcagtccatgcgctgctgcggttcggactgcttggtgccgctctcggcgagagccgtgcgcgcggcctgcagcagttcttcggagatcgggtcgccccgggtggcgcgggcgagggcgagggcgccgaccatggtgcagagctgggccatgccgtcgtcgtcgccggtggccagccgagcggcgcggttgcgtatcccgttgatgtagacgtggcgggcgcgggcggcctggtcgggctcgcgacccaggtcagcggcgaatccggagacggggcagccgtccgcggcgtgatcgcggtgccagaccgagaggtactgctcgatcagcgtccgccgggcggcctcgtgctccccggcgcgctcctcgaacgtcgccgccgaatgtgccgcgtgctcggcgaaggcgtgggcgatggcctcgtcgaccaggtcgtccttggacgcgaactgcttgtggaacccgccatgggtgagcccggcggccttcatcaggtcggcgacgctgaccgcggtgcctttctcgcggaacatccgggaggcggtggctacgacgcgctgccggttctcctgtgcttgcgcctgggacacgcggcccatggaatcactctcctcaattggatgtcacttgccatctatcctagccccgtttagattgtttgcgacatctatttcatgtcgatgagaccccccgcaggtcaggcagggtcttgcgcggcctcccaaggttcgaggccgacggcctccgcccggcaatcgcagaaccaccgacagcactggagaccccctgtggcatcgccacccaccccctccgagtcctcgacgcccacgaggtccacgccgcccgtgcctcctgcccagcgacgacgtgtttccgaggcggtccaccaccgtcgctgggccatcctggccgtgctcgcgttcagcctgctggtggtgatgctggacaactcgatactcaacgtggcgatgaagaccatcgcccagcccgcccccaccggactcggctccacccagagccagctggagtgggcggtcaactcctacacactggtcttcgccggactgctcttcaccgcgggcctgctcggcgaccggctcggccgcaagaaggtgctgctcttcggcatgctggtgttcggcgcgggatccgcgctgtccgcgctgtcggactcctcggggcagctcatcaccttccgtgccgtgatgggcctcggcggcgccttcatcctgcccgccaccctcgcgatcatcatgaacgtcttcgagcgcgaggagcagcccaaggcgatcggcatctggacaggtgtggtcggtttcgccatcgccgccggccccatcgcaggcggcgtcctgctggagcacttctggtggggctcggtcttcctggtcaacgtaccgatcgtggtcgccgcgatcgccgcgatggcggcgatcgtccccgactccaaggacccccggcccagcaggctcgacgcggtgggcgtgctgctgtcgatcgtcggtctggccgtactggtctacggcatcatcaagggcggccagctgggcgacttcacccggcccgaggcatgggcgacaatcctcggcggtctggcggtcctcgccggcttcgtggtgtacgaggcccacagcgaccatccggccctcgacgtcacgtacttccgcaaccggcggttctccgcgtccgttgccgccatcggcctggtcttcttcgccctcatgggcgtcacattcttcagcgtcttctacaaccagagcgtgcgcggctacagcgtcctgcagtccggtctgctcgtcctgccgctggccctctcccagatgttcttcgccccgagagcccggctggtcgtcgaccgctacggcgcccgagccgtgtgcgccggcggcctcgccctgaccgccgtggccttcaccggcttcctgctgctcgaccaggacacccccatctgggtgctggaggtgctgttcttcctgatgggtacggggatggcccatgtgatgccgcccgccaccgtcatgatcatgtcgtcactgccgcgggagaaggccggctccggatccgcggtcaacaacaccttccggcaggtcggtggggccatcggggtcgccgtgctggggtcgctgctgtccaccacctaccgcaacggcatcgacggccacctgggcacgctgcccgccgccgaccgccacgccgcaggtgaatccgttcaggcaaccctggccgtcgccgagaagctgggaccggccggcagcgcgctggtgcggcccgcgcacgacgccttcatccatgccatgcacatcaccgcggcagggtcggcagccgtcgccctggtcggcaccgtcgtcgtgctggtcttcctgccaggcaggaaggtcaccgcggccaccggcggtgacaagtgagcctgcgttcggcacggcaaccggccaccggcggtggcccggcaaagacgccctcctcatggacgtcttgaagaccacggacgggccgacgccggagccggcgggcccgccagatgctgcggccggtctcctcgcaggcggacgggctcaccgagcggacaaccgagacggcactcgaaggagtacgcccgcgcgggtgaggccagtaccgacttcagcgttgccgacctcctccgcccggcaatcgcagaaccatggacagcactggagacccctgagaaatcgccacccggatcagccgtgacatcgccggggccaacgccttgctgccagagcctctgacgctctgatcacacctcaactcagatattccattactccgaaggagatcgactgatgactgccgacaacctcgttctcatccccggtgccggcggcgtgggccgcacggtcttcgagcacttgcgtgctcaggatgtgccggtgcgtttcatggtccgtcgtgacgacgagcgtgcggctgagcttcgggcgctcggcgcggaggtcgtcatcggtgacctgacccggcccgagacggtggctgccgcactgcagggtgtggcgcggatgcacttcgggataagtgtgtcgccggaccaactgctggcggcgaccgtggtggcctccgtggcgcgggagtacggggagctggaggccctggtcgacctgtcgcagatgacggtgtcccagatgaccgccaccagcaccgaggagtcgcaccagcagcggctgcactggctgacggagcagatgctcgactggtccggcctgcccgtggtgcacgtccgaccgacggcgttcctcgacaacccgctgttcaccacgatcgcggcgcggtcgatccaggcgaacggcaccatcgcgttgccgttcggcaccggacgcacctcgccggtcgccgcggacgacgtcgcccggaccatcgccaccgtgctccgcgacccggctccgcacatcgggcaggtctacgaactgaccgggccgcgctcggtcgacatgacggagctggcggcggagttctcacgggcgctgaatcgtccggtgtcttatgtcgacctgccgctggaccggtgggaggcccagctcccgaagctggggatgtcgccgcacgtcgcacagcacgtcgccaccatggcccggctccaccgggacaaccgttatgaccgcacggccgacggcgtcgagcgcgtgacgggcacccccgccatgtcgatcgaggcgttcgtggccgcccgcagggacctctacctgggctgagccgccccgccagggccgtcccccggggcaactgccgagggcgctgagcctctcccggcctggggtcagggacaggggccgagacggtgcttctgctggtcggccgacggcagaggtccttctccccccgcccgaagagcgggccggccccacggagggtgaagccccacgaccgagccgacccgcgggagcagcactgcgacaggtgttgtggtcagactgcctgaactgcgttcgtcggccggggttgtgaggctgtcgggtggagaggcgcgcgggtgaggcgtcgggtcatgagggcgacggcggcgggggtgagcatcgcctcggcatgctggggcaggggctcgtcatcgcgggtgccgcgcgtacgggtggtgcccccgcccccgccgacgggttcagtcgaggctgttggtgaggatccgttcggcgatgccgtcgcgcagggcggtggcgggtgagctgccgggcttgcgttcggcctgatcgcggaagcaggcgaggaactcctccgcgatgccggcgcgcgggtggcgggccaggacctcggctttgaaagcggcggagaagtcgtccatgtgacgtccggagatgtcgaggctcgtggagcgttccaggagatggccctcggggtccttcgtcacgtcgacctcgtcgagcatgtggctgatgacgacctccgcgaggcgctcgcgtcgggactcggaccagcccgcgccggcggcgaagacgcgggccacgtgggcgctggcgtcgtcgaaggggaccgtgtggctgtcgaattccgggaccagggcgatgtcgtggaacatggccccgacgtagaggagttcggggtcgaaggcgatgtcctgctcggccccgtggacggccgcccagatgtatgaccggacgcagtggttcaggagggcgggcgagcagtaggcgcgggccacgtcggtggcggccgtgcagacgggggtgtcggggagcagcaggtcgtccagtgtcatggcgggcagtattgccgaacggtggcgtgggggtgccggggctcgagccgggttccaccggattcccagaatggccgtgcagcgtgcgggagttggggcgtcgggctccggtcaggcagtcggggacggcccgcgcgggcggctcacgagtggaattcgagcggtgcgtgaaacgctccgggtgccccgtcgcgggctcagcggcacggccgcccgtggacccccggtccagcaggtgggacggcccgcagtccgtgcacccggatccgtctcaggaggacctcttgaccacgctcacgttcgccgaggcgtccgcgcactcgggcggggatctgcggtacctcccggccgggcacggggaggtgctggatctgagtacgtgtgtgacccgctccggcccctcgccgcgcgcgctggcggccgccgccgccttcgacccgtcgtccctgacggtccatccgtacggtgccgacgaccgcttccgtacgacgtatgccgcgtatctgggcgtggacgcacggcagttggccgtgacgcggggaatcagtgagcccctgtcggtacttgcgtcgctccttccggccgagcggtcggcggccctgacccccgactacacgggcaccattcggcggtgggcccgtcatctgccgccggccccggacgagcgcgactgcgtggactcgcgggtgcggcgtctggacgcggcgatgcgccactacgcctacgtggtgttctcgaaccccaacaatccgctgggcctgaccgtgccgcgcgacgttctcgcggagctgctgtcccggcatccgcgctgcacgctggtggtcgacgaggcgtatgtcgactacatgggcgaccggcggcagtcggcgatgacactgccccaccgcaatctggccgtgctcgcctcgcccggcaagccgttggggatcgccggtacgcgcacgggagtgctgtggacgcccgatgacgtgctgcgcgagcgcgtggcgcgacggctgcccgagtggccgctgtcggcgtacgacgcgcacgtggcgtgtgcggcgttgcaggacaccgcctggatcgcctcggcgctggagggggcgcgggaggacgcccgccgtctggaggccgttctggtccgctgcttcggggacgcggtggtcaccggcgttccggtgcactaccggttcgtctacgacgagcgccccgagcggcttcacgcgcacctgctggccgacgggatcgcgacacgactgctcgtcgacgacgagccggggcgggtgcgggggctgcgggtgctggcgccgggcagcggggagctggcccgtctggaggcttcactgaacgcgttcgtgcggtgactggcgcgaggttcaacaggcttgcgcagcagggacatcggggggattcgccgggcccgtcgggcgatcggcgcgccgggtggagcgcggccgctgcactcccggcacagggccccttgagagcggcctgaggactccggtgtggggggcggggcgcggctagggtcccgggtcagtcaggtgcacgtccctcgacttcttctcgtgttcggcgtcctcgtcccggcgggcgcccttctcctcggtgcacagcccctggaagcggtcctcatggaattcagctcgcgatcgtcgacctcgtccacgaccggtgccccgctgctctcggtgcgcagcgccggggagatcgtccccgtgctctgtccggacggcttcgaagtgggcggcgggcctcgggtcgtggaggtcgtcgccgaccggtgggcgggcaagtcgaccgtgctggacgggctgtccgcggccctggcgggccggggctggacggtcgcggccggtgcggcgtcgccggcccggtcccgtgcgccgttcggggtgttcgtggaggctctcgaggagctggtggagcacctggatcccgatcggctcggcgggcgcggccgggatcacgcggcacagctcgccgcgctgttcccggcgctctcccctgacgcgccgcgggacacgtccgtggacacgtaccggatctgccgtgccatgcgtgccctgctggagatgctcgccgccgacggaccgctgttgctggccctggacgacgtgcactggatggacgccgattcgctggaactgctcgggcagctgctggagcagccggtcgcggggccggtcgtgatcgcggtcgcccatcgggggcgtccgggcgatcgtgtgctgaacgggctccttgcgcggtgcgcctcccggggcgggtgtctgcgggtgcggcccgcgccgctgacggagcaggaggccatcgcgctgctgccggacgatctgagccgggtgcactgcgagacgctgctggtggagtccggcggcagcccggggctgctgcgggccttcgccacgctgcgtcaggtgccggggctcacgggtgcgtggactccgccgttgccggcggatctgctcgccgatgtgctgcgtgacttccgtgcgctgagcgccgagggctggcaggtggtgcgggccgccgcggtgctgcacgagccgtacgcggccgacgatctcaaggagatcgcgcacgtcgacgacgcggcgctgtggcgtgctctcgacgagctgatccatgaggaactgctgcggccggacgagctgccctggcagctgcggttcgccaatccgctgctgcgggtcgccgcctaccagtcggcgggccggggctggctgctcggcgcgcacgcgcaggccgcgcggatcctcgcgcggcccggctacccctcggcgcacatggccaggcatctggagcgtggcgcggcgctgcgggacgagagcggtgcgcgggtgctgtgggacgcggcggcacggctgctgtggcaggacccgtcccagtccgtctcctggatcagggcggcgctggcgtcgcgggcgggcggtgacctggagccgcgcgatcggctgctgttcggcaaggcgctggctctggcgggccggctcaccgagtcgctcgccacgctggggccgttcgggcagggcggggtcgaggcagggctgcgggtggagcgggtgcggtggcgggcgcatgcgcaccggctcctcgggcacaccgaccgcgcgcaggacgaactggagtccctgctggccgagttggagccgggggaagaggggctgcgggacgtggtgcggcacgcgttgatcgagctggcgctgcacggccgccgcccggtgccgccgccgcccggtgggagcgagccggggatgccccagggggcgacgggggcgctgcggggcaggctgctggcgcagctggccgtcgcggcctgccggggcggggagcaggagcgggccgaacaacgagcactgacggcacgccagttgctggatgcggcaccggacggcgaggtcgccgagcagctcgagggcctgtactggctggcgaccgccgaggcggcgctggggcggccctcagccgcgtgcggccactacgagcgcggactgcggatcgccgagacccgccggctcatcgaccacgtcccgctgttcgcgatggcgctcagcgcgctccagctgcacaccggtgacggggcgggagccgcccggcacgccgcgtgtgccgagaccgtcgccgcggcgacggagagcgagcacctgcgggagcgggcgctgcggctgcgcagggagacggcttcgggggccggcgtcgccgtactgcccggccagcggcagccggcggacgcggcggcggtggccctggaggggctgagccggcgcgagagtgaggtggcgctcctggtgagcgggggccgtaccaaccagcagatagcccgtgtcctggagctgagccacaagaccgtggagacgtatctgggccggatattccagaagctgcaggttcagtcgcgggccgaggtggccgccatggtggggcgttcggaccggctcggcgtggccgcgggctcctgagcggggccgttcggcgcgggcggtcgctcgtggtcggccggcggacggcgggtcgggagatctcctgacaccacaggaagggccggatggtccaggttgggacggtccggacacgggaggggcggtcgtggacgtggcctctccatcaccacggatccatcaccacggacacatcaccacggttccatcaccacggaggaagcagatgagcgatcgggacagtgccgacatcgcgtacgcggtggtcgtcaacgacgagcagcagtactcgatctggcgcgccgacgccgagttgccgcccggatggagtgccgaaggcaccaccggcacgcgcgaggtgtgcctggcccggatcgacgaggtgtggacggacatgcggccgctgagcctgcggcgcgcgatggcgcaggcgggccgcagctgaggccgtcggcgcctcatcgacatctggaggactcaatgcagacccagctctcccagggcgctcaactctccgccgagcagcggaagttgctcgatcagctgctggacgcggacggtatcgaccgggtcgccggcaaggtgacgcggcgcaccggtgacctgtcccgcgcgccgctgtcgttcgggcaggagcggctgtacttcgtggacaagctgcgtccgggttcaccgatgtacgtcggttccggggcgctcaggctgcgcggtgcgctcgacgtggaggtgctgcggcgctcgatcgcgctgctcgtggaccggcacgaggtgctgcgcaccggtgtggtggaggacggcgacggtgtcgagcagcgcatccggccggccgggacggtccaggtagagctgccggtccggggtgccgcgtccggcgaggtggccgaccgggtgcgcgaggcggccgcggagggcttcgacctgtccgcgcccccactgctgcgggccgtgctcctggagatcaccgacgcggcggagccggagtgggtgctggtcctgtccgtgcatcacatcgccgtcgacggctggtcgctcggcctgctgatgggcgagatgagcgagctgtactcggcattggtacagggcgccgagccttctctcgccgaactccccctgcagtacgccgatttcgcctcctggcagcgcggctggctggagcagggcatcatcgccgatcaactcgcctactggagtgaccagttgagcggagtagaggcgaccgaggtgcccagtgaccggccgcggcccgcggagcgcagctacctgggtgacaccgtgccgctcgcgctggacaggccgctgacgcagtcgttgcgggcgctgaccgacagcggacagtcgaccctgttcatggcgctgaccgcggtgtgggcaagcgtgctcggccggttcgcggaccggcgcgacgtggtggtgggcactccggtggccgggcgcacgcgcgccgagctggagagcgtcgtcgggttcttcgtgaacacgctgccgctgcgggtccgcatcgaggacggcgacaccttccgtacgctgctgctccgcacccgtgaggtgtgcacccaggcgtacgcccatcaggacgtgccgttcgagcggatcgtggcggagctgcagtcggggcgcgacgcctccgggcagacggcgatcgcccggcactggctggcgctgcacaacacgcccgcccccgatctgacgatgccgggcctcatgagcgaagcgctgcccgcgctcatcggcacggtgcgctgcgacctgtcggtgcaactggcgccggacgggcagggcgggctgagcggccgcctcgagtactccacggaactgttcgaccgggccacggcgaagaccctggcatcggctttcgagacgctcatcgcctcggtggcggccgcaccggacagcccgctggacgagctggacatgctggccccgcaggcgcgcgaacacatcgtgcgcgacctgtcgggcgctgcccgaggtgccctcaccggcccctgggtgccggagcggttcgccgcgcaggtcgacgcccaccccgacacggtggcggtggtcgaggccgacggcgggcagctgacgtacggccaactcgacgtgctcgccaaccgggtcgcgcacctgctgacggcgcgcggtgtcggcgccgaggaccgggtgggtgtactgctcccgggcggcggcgcgctcgcggccgccgtgctcggcgtgctgaagtcggcggcggtggtgctgccgctcgaccccggctacccgcccgcccgtctcgcccagctggtcgaggacggcgcgccccgactggtgctttccggtgccgggtcgacggatctgctgcccgacctggacgtcgtggacgtcacgggcgaagaggtcgcgggccaccccggacaccgcccgccggccgtcgcgacggccccggacgccggtgcgcatctgctgttcacgtccggcacgtcgggccgccccaagggcgtgctcaccacccgtgccggcctggtcaatcgcctcatgggcatggagcggcagttctccgtgggtgcgggtgaccgggtgctgtgcaaggcgccgctgggcttcgacgtcgcggtgtgggagctgctgctgccgctcgtcaccggcgccaccgtggtgtcgtgccgggtgggcgggcaccgcgacctggagtatctgcgcgagctgatcgaccgccacggggtgagtgtctgccacttcgtgccgtccttgctcgaggagttcgcgaacgccccggccggtgcgcacccctcgctgcgtctgctgctcagcggcggcgaggagctgccggccccgctcgcggaacggatcctcgatcggttcgggcacgccgagttcgtcaaccagtacggaccgaccgagaccgtcatcgacgtcacctccgggcgggtctcggggcccgtcccgcaccgggtgccgatcggccggccggtgcccggtgccgaggtgtacgtcctcgacgcgtcgatgcggccccaacctgtgggcgtcgttggtgagttgtacgtcggcggggtgcaggtggcccgcggctacgtgggccgtgccgcgctgaccgccgagcggttcgtgccgcatccgttcgcgcacgggcagcgcctgtacgcaaccggggaccgggcgcgcctccttgcgggcggctcggtggagttcctcggccggaccgacgaccaggtcaagatccggggcaaccgggtcgagcccgcggaggtcgcggcggtgctgcgcgcccacccgcaggtgtcgggcagccacgtcaccgtgcagcgcaccggcgcggcaccgcgtctgaccgggtacgtgacgtcggacgccgcgaacgcggacgaactgacggaggagctgcgtgagttcctgcgcgagcgggtgcccgaggcgatggtcccggcgcagctcttcgtgctgaggcagtggccgaccggtgcgcacggcaagatcgacgtgacggcgcttccgcagccctcgggcgaacgtccgggcgcacagcgagagttcgcggcgccggtcactgacgtgcaggtccgcctcgccgcgctgtgcacggagctgctcgaggtggagcggatcggtctgacggactcgttcttcgacctgggcgggcactcgctgctcgcgatccgggcgatctcccgcatccgcaaggagttcggggtggggctgcagatcggccagttcttcaaggcgccgacgctcgcgggcctcgccgaggcgatcgaggcgaagctcgcggccgcggacgggaagccggccggaccggccccgatccccaggatcgaccgcggcgcgcagcgccgctgaccggccgccacccatcgtgagggagactgagcatgaccattgaggtgcacgacgccgtggccgtgagcccggtgtgggagggccgttccctgcccgcgctggtgcgctgcgagagccccgggggggcgctgcccgcctgggtgagcgcccatcgggacgaggtcgacgcactggcacgcaaggccggggcggtgctgctgcgcggcttcgacgtgcgcggcgcgcaggacttccgggccgtgatggacgccctgtcgccgcaggtgctcgcctacggcgagcggtcgtcgccgcgcagccaggtgtccgacggcgtctatacgtccaccgagtacccggcggaccagccgatcctgctccacaacgagcagtcgtacacggccaagtggccgacacgcatcgtcttcttctgcgagcgggcggccaccgagggcggccgcacaccgctcgcggactcccgccggatcctggcgcgcctgcgcccggagacggtggacaggttcgagcgcctgggagtgcgctacgtccgcaactacctgccaggcatcagcctgcggtggcaggaggcgttccagacggaccgggtggaggacgtcgccgcctactgtgcgcgtgccgacatcacgcccgagtgggtggacgaggaccatctgcggaccgtgcaggtcaggcccgcggtgcgcaggcatccggtcaccggggagcgcagctggttcaaccacgcgctgttcttccacgtgacgtcgctcgacccggaggtcagcgccggtcttctggaggccctcgacgaggaggacctgccctacaacacgtactacggggacggttccccgatcgagagcgagacgctcgcggagctgcgggccgcctacgcggccgagaccacgggcttcgactggcagcccggcgacgtgctcgtcgtggagaacatgctggtcgcacacgcccgtgagcccttcgtcggcccgcggcgcatcctgaccgccatggccgacgccatcgacgccggcgaggtgcccgcatgacgctcaccgacctgacccccgcgctggaggacggcacggtcacggtccggccgctgcacgaggagccgttcctgctggagatcgaggcgcgtgagccgggcctcgacctgccgcggtgggtggccggccgcaaggaggagctgcgggcgggcctcgaccgctgcggcgcgctgctgctgcgcggcttcgacgtaccggacccgcaggagttcgggcgggccgcccgcgcgttctcgccggacctgctcggttatctggagcgtgccgcgacccgcacggaggtcgccgacaaggtgttcacctcgacggagctgggcgaggaccagtggattccgttccaccacgagatgtcgtactcccacaactggcccggcctgctgtacttcttcggcgatctgccgtcgccggagggcggcgccacaccggtggccagcgagcgccgggtgttccccctgatcccggccgaggtccgggagcgcttcacacggcacggagtgcggtacgtgcgcaactacggcccggacctcaacgagtcctggcaggtggcgttccagaccaccgaccgggccgaggtggaggcgtactgccggcagtcggacaccgcgttcgagtggaccggtgacgacgagctgcgcaccaccgcggtgcgccaggcggtggcgaggcatccgcggaccggcgagacggtctggttcaaccacgcccatctgttccacctgtccaacgtggagccggaggtcgccgagatcctcgtcgaggagtacggcgaggagggcctgccgcgcaacgcgtactacggggacggcgcgccgatcgagaacgaggtcgccgagctgatccgatccctgtaccgggaggccgccgtgtcgttcacatggcggcgcggcgacgtgctcgtggtggacaaccacctcgccacgcacgcccgggagccgttccgcggggaccgccgcatcctcgtcgccatgtccgacctgcacaccgagctgccggccggccgatgacggctgccgcgggccgtcaccgcaccattcgcaccaccggaggaaccatgctgctgcgccccaccaccgacgccgacctcgcccgcgtcaccgacttcattgtcgaggagccgatcagctggattccggccgaccgctaccgggccgaactcgccgaggggatgtaccggccgcagtggtcgtggatcgccgaggcggacggcgacatcgtggcgcgggccctgtggtggggccaggccgcgagcgagcacccggtggcgctggactgtctgcacgtggcgccctcggtgcccgacagggcgggcctcgcggccgatctgctgcgggccggacacacggcgttcggccaggcgggcgccgcgcagccgccgctgtacaacctgacgctgtccaacggctggcgtgacgaccccgcggtgtcggccgcgctggcctggcggcgcgaagcggccctcgcggccggtctcacccacgaggtggaacggctgcgcctggagtggacgcccgggaccggggtgccggccgagtcggggcggctcaccttcgaggaggcgcccgacgaggagttcctcgacgccttccgccgggtcgccgagggcagcctggacgccgagacccgtcagcacctcgcggcgcacgggccctcggccacggcccgcaaggaactggacttctacctcgggtgccccggcgagcgcgcctggtggcgcctcgcgcgcacgcccgacggggccgtcgccgggttcgcgatcccctcggccaccccgtacaacccgaacgtcggctatctgggcgtggttcccgaactgcgcggccggggctacgtcgacgtgctgctcgccgagatcacccgcagccacgcggagcgcggcgccgaactgatcaccgccaccacggacacgggcaacgcgcccatggcggcggccttcgaacgcgccggttaccgcaacacccagatccggatgctcttctcggccccggccggctgatccgccgagtcctcctggagtacgtcatgacgcagaccgcccccttgtccccgagagaccgcccggcggcgacccccgagcccgcgagccgcccctacgcgcgcggctaccagtcccccgccgcactgcgccccgtcctgcgcgcggcccatcacacgcggctcgccaccacggcggcggtcgccgtcgcggaccaactcgtgctgatcgccgcgatactggcggcatcctggccgggctggtggtcggcgcccgcgccggccgcggccggcgtactcatggctctgaccgcactgatcctcacgggacgccagatacgggcgctggagtgcctggtccacgaggccagccacttcaactggagccgccaccaccgtcgtgccaacgacaggtgcgcaacggtcctggcgggcctgcccaccggtatccgcatcgcccgctaccgggccgaacacctggtgcaccacagcaggctcggcaccgaggacgaccccgacctgcagcgctacgcggagctggacatcaccggcctggaccgcacgagccgggtgggctacgcccgttccctgctggtgcggatcgccgcccaccaacgcggctggtaccggtccacgtccacggacctgccggcgctgctgctgccggtgggctgggcactgctggtcgtgtcgctccccgcggctctcctgtggggcgccgccgcggccgcggtggccgccggggtgtggctgaccgggttcgcgctcgtcctgcccgtgctgcggttcatcggggagtccagtgagcacagctaccacgacgcggacaccgtcttcgactccaccatcaccaacatcggcccgctccagcgccggctcatccatccgcacagcgacggctaccacaccgtccaccacctgtggcccggtgccccgcatcaccaactgcggctgctgcacgacgaattgatgtccgccgacccgcagggattcgccggccggctgcgcacccgcagccgcatcgtggccgaccccaccccccgtaccggccccggcagcacgccgtggacgtgaccccctgacacctgcctgaaccaccttcgaggaatgagacccgacatgagtgaggtcgcagtggagcagttgaagtttcttgcaacggacgacgtgcgcaccgtcgccgaggagttcggcacgccggtgttcgtgtacgacgaggccaccgtgcgcgcctcgtcgaagacgatgtccacccttcccaacgcgttcggcctgacggtgcgttactccctcaaggcgtgccccggccaggcgatcatccggctcttcgaccgggaggggttctccttcgacgcgagctcggtgtgggaggcccgccgcgcggtgctcgccggggtcgagccggggcgcatctcgatgaccgcgcaggaggcggtcttcgacgagaacctgcgcgacctcatcgaccaggggctgcagttcgacgcgggctcactccaccagctcgaggagtacggccgcgcctacccgggcggtgccgtcgcgatccgcatcaacccgggcttcggctcgggcctggtcggccgcctcaacagcggtggcccgcagtcgagtttcggcatctggcacgagcagctgcccgaggtcaagcagatcgtcgagcagtacgggctgcgcctggtgcggctccagtcgcacatcggctccggccaccactgggacatcctcgtcgacgcggtacgcaccatgctgtcgttcgcccgcgacttccaggacgtgcacaccctggacctcggcggcggctaccgggtctcggccctgcagagcgacccggtctacgaccacaccgagtgggcccgcgtcgtcgccgacgagctcaagcagttcgccgaggagaccggccgccggctgcacaccgaggtggagcccggcacctatctgacggcgctggccggctcgctggtcaccaaggtcatcgacaaggcggacaccggcgcggaaggcaactccttcctcaagatcaacagtggtctgaccgagatcgcgcgcccttcctactacggcgtccagcacccgatcgtgtcggtccccgccacgggcggcgccgagcgcgcggccgacgaccgcgaggagttcaacgtggtcggccactgctgcatcgccggtgacgtgctcaccgcgaagcaggaggagctggcgccggtgccgctcggccgtacggagatcggcgactacgtcgtcatcgagcgggcgggcagctactgctcctcgatgtcgatgaagaacttcaactcctaccccgaggccgccgaggtgctgcgccgcactgacggcagcttcgacctgatccggtcccgccagagcatcgagcaggtcatcgtcaacgagcggatccccgagggtctgtgacgtctcgccagaaaagcacagacgctcggccgggggtttccccggccgagcgtcttgcgtggggctgctgagatccgagtcttcaggccgcgccgcccgtcagagcacgtatcggcgggagaccagcgtgagtcccgagtcgtccgcggaccaggtcacgtcggccgggcgcgggacgctcagcgtgcccccgggcagccccggggtccgggtgacggcgcgcagcgtcagcggctgcgttccgcggagtgtcagttccacccgggtgcccggcccggtgggcggggcggcgaggagcaggccccagcgccagccgtcgctcgcgaagggccggttggtcccgccggggacggactgtccggccacctcggcgcgcaccacggctgcgccgccggcgtccgcgtacaggccgatctccgcggccctcgcgtccgtggcgcgcacggacaggatgatgcggcggacgtcgcccgcgcgggtggtggagacgaccttcacctcggggacggcgacggtcgcggcgggcgcgggcccggtgtgccagcgggacggctggtcgagggagggaaaggtgctctccagggacgtcgtggcgccgccgacgtagtggtcgagccaggcggagtctcccgctccgctggaggcccagcgggcccggccggtgtcggcgtccagcgcgtagaggaggctgacctgcgcggggcgggacgcggtgggcgcaccggcgagcagggccgcgccgagcgcggcgagagcggctgccgtgccgaggccggtgcctgtgacgagcgagcggcggcgggtcttggcgggcaccgcgggcagtgcggtggcgagcgcgagggcgagcaggagcgccggggcggcggcgaaggcgatcggcaccgtgtcgaagaggagcgcgcccaccggcaccagcagggcggcgcacggcacgaggggcgccgtggccagtgcgccgcgccagggcgagccgggggcgatgcgggccgcggccgcgagtcccgccgccccggtgagcgcgggccacaggaacaggtacgaggcgcccggcagccagacggcgctcagcagggtgcacagggtcagccacccggtgaccgcggcgcccgcctccagagcgctgacccggcggcgcatgacaaccgcccacacccacagggccgttgcggtcaggagtgcggcggtcaggtgcagcggtcctgccgtgtaggggctgcccagcgcgaacccggtccactgcggcctgagccaggtcgcgacgggccacaccgcgctgaccgccgccgccgcgcccagcagggcgagcggcagtgaggccgcgctcagcgccgcctttcgggcccggacggctccgcgccggcgcgcgtaccacccggcggcgccgagggcggccacggcgaggagcgcgccgggcagcaccaggcccatcgggtagcggacgaggaccggccccagggtgaagtacgtggccccgcccgcgtgcgacgtgccgctcaggtcggcgccgcccagccggcgggccgcggccaggacggtgtcgcccatgtcctgcaggctcgcccggctgaagtgggcgaggtcgtcctggggggtgtggtagttcgcggaggtgccgatcacggcgaagttcatgccggtcatgccggcctcgcgcagcacggtgaagtcggtgtcgttgggcagcatccggtacacctcgtcggacagcgaggtggccaccgggacccggtcgccgagcgcggggaccacggcggcgttcccggttcccgtctcgaacatgaccgcccgtcccgaggtgccccgcgcctccaggttgaggaccacggtggaggccgccggtgccgtgtcgcgggcgacgaaggcgcgggcccccagcaggccgggctcctcgccgtcggtgatcaggaaggtgacgtcgttgcggggggccggacccgtcttcagggcgcgggccacctccagcgcggtggcgaggccgatgccgtcgtcggaggcgccgtggctgttctccgcagagtcgtagtgggcgacgatcagcaccctgccgctggggtgggtgccgtgcacggtggcgctgatgttctgtgtccaggcggtcacggccgcgccgttgccggtgtcgctgctggtgcccggctcgacgcgtacgccgagccccaactcgcgcaggcggcggatcacttcgtcgcgtgcgcggtcgtgggccgcggtgccggtggcgtgcgggccgcccgacacggccgccaggtgcgggtaggcgcgcgcggcggagaaggagcccgccggtgccgacgccggcgccggggcgggggtcaggctcgtccagagcacgccgacgagagcgacggcgagggcgagcaccggcaccagaaggcgggtgagggcccgcatcgccggtgacgggcggggcgggcccggtgcgggtggccgcggttcctccgcagcggtgaggtccgcgggggtggtacgggtgtcggccatcggtcagctgcttccttgtcgtcggtgtgctcaggtccgttccggtgcctcggtccgttcggccgccacggcctgtccggtccgcggggcgggcctgtcgtcccccgccgcgtcgagggctgccggggacagccgcagcagcgccgtcacggtggccgcggcgagcagggcggccgcgaacaggaacggggcgcgcagccccgcggcttcggcgagcgcgccgccggccacgccgccgagcggagacactccgttgacgacgaaccggtagccgccgttgacccggccgaacagttcgccgggcaccagcgactgccgcagcgaggtggtcaccacggtcgccagtgagatggcggcgccgacgaaggccagggcgccggcggcgagcagcgggagcgaggtgagtccggcgatcaggaacggcaacgggcacagggcgaaggccagttggagcgtgcgggcccggccgatggcccgggtgacgaggggggcgagcagcacccccgccaggccgcccacggcgaggacggccaggagcaggccgtaggcgcgctggctgatgtgcagcacgttcagcgcgtacaggacggcgatgctcaggaccgcgaccacggcgaagttgagcgcgccgaccagtacgcacacggtgcgcagcactcggtggcgccacagccagcggatgccgtcggcggtctcggccaccacggcgcgcgcggtcagcctgcccgccgcggtcggcgcggggcgggcgcccgacaggcggatgctgaacaccaggaccgcggagacggcgaaggacagggtgtccacagcgaacggcaccggtcggccgagtgcgaacagggcggtgcccagcggcgctcccaggaactcgctgctcaccagctgaccgcccatcaggcggctgttggcagagtccagggagccgccgccggtcacgtcggggacgacggcctgcgacaggttctcggcgagcgtcgtgatcgaggtgagcaggaacgagacgacggcgagggcggtgatcccggcccggtcggtcaggatcagcaggaccagcgcaccggtgaccaggacccgggcgacatcgcagatccacagggtgcgccaccggtcgaggcggtccaccagggcgccggcgaacggccccacgcaggtccacggcagctttcccgccatcgccaccagcgcgaccgcgaaggggtcgtgggtgagggtggccgcgtagacggcgagggcggcggtgcgcgtgccgtcgccgaatccggaggcggcggtcgccgcccacaggcgcccgtacccgtacgcgaatcgcggcgtgcgcggcgccacgggtcagccctccagcttctgctgcacctcgttgtgcgacatgctctgcacctgccgcacgagggcggccacccggtccacgtcgatgcctgcctcggctccctcggcgcgcatcagcgtggcgagggtggcgacggtgggcgcctcgacgaagaagtgcagggggagttcgagccggaacagttcacggatgctggagacgacgatggtggcgagcaccgagtggccgccgcgttcgaagaagtcgtcgtcgaccgagacgtcggtgatctccagggtctgctcccagacaccggccagcacgtgctgcaggtcgtccgcgggagcccggcgctcctttgccgggccccggcccggccggggcagtgaagccctgtcgatcttgccgtacggggtgagcgggaaagcgtcgagcgcgacgaagacatccgggaccatcggcgagggcagcgccgcgcgcagatgtgtgcgcagggctggggtgtccggcgcgctctgcccgggcgccacggtcacatagccgatcaggcgggcgccgccgtccggggccgcgtcggcgaggacgagggcgtcggcgacctgggggtgggcgcgcagcgcggtctccacctcggcgggttcgacgcggaacccgcggatcttgacctggtggtcggtgcggccgaggaactccagggtgccgtcgggacgccagcgggcccggtcaccggtgcggtagacgcgggcgccggggacgaaggggtgcgggacgtagacctcggcggtctgggcggggcggccgaggtagccgcgcgccacctggacgccgcccgcgtggagttcgccgggaacgccgacgggctgcacgcggccggcgccgtccaggacgtagaggtcgccgcccggcacgggacgtccgatgggcacgggggatgcggcgggcgcggtgacggtgtgctcggcgatgttgatggtggtctcggtcggcccgtaggagttcaccaggcggatgtgcggtacctggaggaggagttggtcggcgagatcggccggcagctcctcgccggcgctgatcaccagcctgagggcggcggcgcggggcagcccgccgaggccgatggcggggcgcagcgccgagggtacgaagaagcaggtggtgacggcgtgccgggtgagcacggagtacaggtagtcgacgtcggtgcccaggcccggggcggcgagcaccacgcggccgcccgaacggagcgcgaccaggagttcccacatcgaggtgtcggcgctgagcggggtcttgtgcagcacgcgttcgtcggcgcccaggccgaggtccgcgcacatgccggccagccggctggccagtcccgcacgggtgatgagcacgcccttgggggcgccggtggagccggaggtgtagaggacgtacgcgccgctggcgggcagttccggcacgtcgggcccggttgccgggtggtgcgcggtgagggcgggcaggtcctccacggtgagtaccggcgtgccctcgggcagccgggccgcgagccgggtgtcggtgagggtcaggcacggcgtggcgtcggcgacgatcccggccaggcgccccgcggggtgctcactctccaggggtacgaggacggctcccgccttgagcacggcgaggaggcagaccaacaggtcgaggccgcgcggcagcagcagcgccacccggtcctcggggccgatgccgcgggcgcgcagcaggtgggccagccggccggcccgctcgtccagctcccggtaggtgagacggtgcccggtggcggggggcgggacgtcggcgacgaccgcggtggcgtcgggggtggccgccgcgtgggcgtggaaggcgtcgaggaggccgtcgccgcccggggccggcgcgtcgcggcccgaccagtgcagggccagcgtggtgtgctcctcctcggtcaggaccggcaggtcgcgtacggcggtgtcgccgtcggaggcgatcgcggcggtgaggacctggtggacggctcgggcgatgcgttcggcggtgtcctggtcgaacaggtcgaaggagtacgacagccagccggtcaggccgccgccgtgctcggcgggcgagaactccagggacaggtcgatgtcggacccggtcttgggcaggttgagcgtctcggcgcgtacgccggccagttccaggtggcgcaggggcacgttgcgcagcgcgaacagggcgcgcaccagggccgagcggccgctggtgcgttcgccgccgacctcgcgcacgatccgcgggaagggcacgtcctggtgggcgaagccgtcgaggctgctgtcgcgggtggcgcgcagcagctcgcggaaggaggcggcgccgtcgacgggcacgcgcagcgggagggtgttgacgaagaagccgatgagcggctccgattcgggccgggtgcgtccggcgacggcggtgccgatgaccaggtcccgcgcggccgaccagcggtgcagcaccacggcgtacgcggcgagcagcaccatgaacggggtcgccttctcggtgcggccgagccggtcggcccgctcgacgagctgggcgtccaggtcgatgcggacggcggcgccggagaacgtcggcctggccgggcggggccggtcgccggcgagttccagagggagcaccccgtcgagctgttcgcgccagtgggcgatctgccgtgcggcctcgtcaccggccagccatgcgtgatgggcggccgcgaagtccgggtactgcacggcgagttcgggcaggttcgcggggcgcccggtgagctgggccgcgtacccctcggtgagttcgtcgacgagcacgccgagcgaccagccgtccacgacgatgtggtggacgcacagggtgagcagccaggagcggccgtcgggggcctcggggtcgtcggtgagctgccacagcttggcgcgcagcagcggcgcggcggacaggtcgaaggggcgccgggcgatccggtcgaggagtgcgggcacctcgtcggcgcgggcccggccgcgtccgagtgcgacgcgcacctcgtcgggggtgccgacgacctgcaccacgccgtgttcggggtcggtcgcgaagcgggtgcgcagcgcctcgtggcgggcgacgaccgcggcgagggcccgctccagcgcttgggtgtccaggtcgccgcgcagccgcaccgcgatcggcagcaggtagttcaccgcggacgggtcgagctggtactggtagtagagctgctgctggccgggggatgccacgtagcgctgtgcctccccggtgcgcggcagagccgtgaccgagatgccggagccggccctgccgcgggccaggtggcgggcgagcagggcgcgccgctcggggctgagctctgccacggcgcgctgcagggcggaggcgtcagcgggcagggtctcggtcatcgctgtccctccgcatcggccgcgacggggtcgaagtcgacgatcagtacgtcgcggtggctggggcgggccgggtcgacgggggccaggggtgtcacgtcgtgcagcaccttgcggtcgtcgaccaggagctggtcgccgggttcgccgagggtgaccgcgaacagctggttgccgtcgtcgtcgtagagggagctctcgccgccactgacgttggtgcggttgaccaggagcgaggtgacgtaggccccgccgtcgcggtggcggccctgaggggcgggcctgccggtctggtcggggctggtcacgatccggaacgggtgcagcttgacatcccagagccggacgccttcggcccgggagaacacgtcgccgagcaggtgcacgacggcggccgtcagagggtcggcgaggaacgcctcggtgagcgggtcgaagctgcgctgcacgccgccgttgagcgggttgagggcgctgtcctggaagtagggggcatggggctgcgcggtcagctcgccggtgcggacgtcgaggcggaagtgcccgtagcgccggtagcggtaggtgcccccgtccttcatgaaggtgtcgagggtgaggtcgtcccagtggcgggcgaagcgtgcccagtcctgcgggccggtgccggtgagccggcgcacctccggtgcggtcagcagatggccgccccatcccgacaggcctgtgacggcggcggtcaccgtccgcgtctgggcggcggccgtggtggtctcggacacgaggtcgagcccctttcggtgggcggccggggacagggccccggcggcggtgcggacggatcgcatcggcacgcgtcgcccaggtgaggccccgcgagcggtctttggatgcaacaggcccgcacgccggtgcggcagtcaggacattgcctgactgccgcacgcgtccgggccgaccgaccatcccggtaagggctgcccgagcagtcggacagggagggtgacgatgacggccgacgattcgctgacggtggtgacctcgttcgcccagcagagcctgtggctgcagcatcaggtggaccccgaccgtgctgcgtacaacatcactgcggcggtacggctgcgcgggccgctggacagcgcggcgctggagcgggcgctgaacgcggtggtggcgcggcacgaggtgctgcgcacggacttcgccctggacggcgaggacccggtgcaggtggtacggccggagcgcgaactgcgggtcccggtgctcgacgccgggcccgacgacttcctgcgttacgccggcaaggtgctgttcgcgcccttcgacctgcgcggcgggccgctgctgcgcctggagctgctgcggctcggaccggagcaccacatcgcgctcctggcgctgcaccacatcgtcaccgacggggcgtcctcggcgatcctgctgcaggagctgtcccacgcgtacgccgccgaactggccggcgtggagccgctgtgggaagaactgcccatccagtacgccgacttcgcggtgtggcagcgtgacgcgctcagcggtgccgccctcgacgagctgaccgggcactggacgcggaccctggcgggcgccgagccgctcgcgctgcccgccgaccgggagcgggacgccgacgcttccgggcacgccgccgtgcaccacttcaccctgcccgccgcactcacggcacgcctcgaggatcttgcccgcgccgagcgggccacgctgttcatggtgctgctcgccggactcgacgcgctgctcgcacgctactgcgggcaggaggacatcacggtcgtctcccccatggccggccgcggccgccccgaactggaggggctgatcggctacttcgtcaatccgctgctgctgcgcacccaggtgtccggcactgcgggcttcgccgcgctggtgggccggacccgcgacacctgcctggacgccttcgaccgcgaggagctgcccttcgagcaggccgtcgaggtgctgcgcggacacggcgctcctggcgccgagagcctgcgttcgcaggtgatgctggtgctgcagaacacgcggccgaaccactggcacagcgccggcatcgacttcgaactgatccccgccgacacgtcgaccgccaagtcggacctcgtgctcgaggtacgccccggcgccgacggcggctgcacggccgccctcgagtaccgcacgggcctgtacgacgccgcgaccgccgaccgcgtcgcccgccacttcgccgccatcctggaggccgcctgcgagcggcccgacgagcccctgtcgcagctgctggcaaccaccgtccccgacggggagatccccgcggtgcgcagcggcgccgcgcacggcgaagctcccgccgcgaccgagtacgtcgcgccccgcaccccgctcgaggaggaggtcgccgggatctggtcggcgctcctcggcacggaacgcgtcggcgtgcacgacaacttcttcgacctgggcggccagtcactgctcgcggtgcggctcgcggccaggctgcgggacgagttcggcgtcgagatgacggtgcgcgacctgtatgccgacttcacgctcgaggcggtcacctgggccgtgctgcagcggatgacggccgacggggaacaggcgcccgcctgagcgaccgcagtccgatccacaccacccagcggacccacggattttggagagacatgttgagtgcggcggttctgtgcttcgcgcccgccggtgcgggagcgagcttcttccacccgtggctggggcagcgcgagggccttacggtgctcccggtcgaactgcccggccgggagaagcggttcgccgagccggagtgcaccgagctcggcgccctgatggacgcggtcctgcccgccctgcggtccgcgacggccgggttcgacaaggtcgccgtcctcggacacagcttcggcgcgctgctcgcctacgaggcgacgcgcgcgctcgccgcggagcgggacgggctgacgctggtggcctccggcgcgacgtggccgggcacactgcgccgcgggcggatcaccggcctggccgacgacgagttcatcgccggtatccacacgatcgccggataccgccacccggccctggacgagccggagttgcgcgatctggtgctgccgccgctgcgcaccgacgtcgcgatgcacgagaactacgtgtacgtcgagcgtgagcccctcgacgtgccggtcctcgcggtacgcggcgacgccgaccggctggtgtcggccgacgacctcaccgagtgggagcgggtcaccaccggcaccgtgaccgtcgcggagctcaccggtgcccacatgtatctggtggaggagtggcccgcgctgctcgacctgctcgccgggcacctcctcggcgccgggacgccgtcatgagcggacggctcacgggccggaccgcgatcgtcaccggcgccgggcggggcgtcgggcgtgcctgcgccacggcgttcgccgcgcagggcgccgacctggtcctggtcgacatcgccgccgacctcccgcacgtcccctaccccgcggccaccccgagccagctcgatcacaccgcccggctgtgccgcgagcagggggccgccgtgctcaccgcacgcgcggacgtgcgggacgcggcggcctgcgagcgggtggtggccgatgccgtggaccgcttcggttcgctggacgtgctggtcaacaacgcggggatcgcgggtccttcgggccggatcgtgcacgaggtcaccgaggacgagtgggcggtgatgatcgacgtcaacctcaacggcgcctggcggatgctgaaggccgcgggggcgtcgatggtggcggcccgctccggctccatcgtcaacatcgcctccaccgccggactggtgggataccgcaacttcgccggctacgtggcgtccaagcacggcctggtcggcctgacgaaggccgccgccctcgactacgcgccctaccgggtgcgggtgaacgcggtctgccccggctcggtgcgcgacggcgaggcgtgggagggccggatgctggtggagatcggccgcagcatcgggatcgaaccggccgaccacgaagccgagttcatcacgcagatgcccatgaacacgctggtggaggcggacgatgtggcgggggccgccctgtggctcgcctccgaggagtcccgtcactccaccggcggtgtgatcaccgtcgacgccggctacagcgcccgttgacccggaccggtcaggagacgcccgtgtcgtccaactccccttcggtcgccgcccggcacgccgccgtgtacgcggtcgcccccggatactcggccgaggactgccgtgccgcgctcgccggcgccccgtggcccggccccggcaggttgcgcctgtgggccgagccggtgcccgccccctcggacagccccgctgccctgcgccgccgcacccgcgagctgcacggccgtcacgggggcgaaggtgtccggctcaccctgctcgaatacgccgacggggtacgggatctggtggccgtgaccggccccggcgacgacggcgccgaccgcctggaccgcgccgcgctggccgccctcggcccggcgcggcccctggccggctcgggatccccttcggaccccgggtgccgggcggtgccggtcccggggctcggcgcgggcggggccatggccacggcctgggacctgacggcggctctgctcctgatcgccgccaggacgcgggcgcaggacgagccggtcctggacgtcgccgtccacaccaccgacggggtgcgccgcgtctcgctccgcgtggccgcgttggacgaggaccagccggtgtccgcctaccgggcctgggtgcgcgagcaggcggagcaaacgagtgcccaggacggtggcggcgggccgcggctcgccctcgatgtggacctgcggccgcgggcggtgcccgcggtgcggcggctgcccgcgctgcacgcccgccacccggtcaccgtgcgggtcaccgcctccgacgcggacggcaccccgcaggtgcactgctggaccctgcccggaacgcccgcggaccagctgccgacagactttgaacagcaacttgccgtagtggcacaccagctgctgtgcggggaccagaatctcccgctggccgacgtcgcgttgcacgagccggccgagcgagcccgcatcctggatctcggccgcaccccgcgcgccgcggacagcgggccgcgccgcatcgaccagctggtccgggaccgcgccgagcggaccccggacgccgtcgccctgagagacccgcagggcgagcacacctggacgtacggtgaactcgtcgacaggagcgaccggttcgcggccgctctgcgagggctcggtgtgcgcccgggcgaccgcgtaggggtgtgcctggaccgttcggcacagctggtgtcggtgctcctcgcggtgatgacggcgggcgccgcctacgtaccgctggaccccacctatccggccgaccgcctggcctacaccgccgacgacgcgggcctgtccctggtggtggtcgaggacggcggcaaggacgacggcaacgccttcgccgaccacgccaccgtgaccctgccacgcctgcgggaactcgccgccggacagggcgcgtgggaggagcccggcacggtggggccggacgatccggcgtacatcatctacacgtcgggctccaccgggcgccccaagggcgtcgtcgtgccacaccgcaacgtggggcgcctcctggatgccacggccgacgacttccgcctgggcccgcaggacgtgtggacgtggttccactcggcggcgttcgacttctcggtctgggagatctggggcgctctgggcaccggcgggcgcctggtcgtcgtgccgtactggacctgccgctcccccgaggacttccgcgcgctgctcctcgacgaacgggtgacggtgctcaaccagaccccgtcggccttctcccggctgctgcccctggagcgcgcggcgccgacgccgctcgccctgcggctcgtcgtcttcggcggggagccgctcgacgcccgcgccctgctcccgtggttcgacacgcatccggagtccgcgtgccggatggtcaacatgttcggcatcacggagaccaccgtgcacgtgacggcccagaccgtcacccgcgccgacgccctcgcctcctcgcagtcggtgggccgcgcgctgcccggctggagcgtgcgggtcctcgacacacgcggcaggctggtgcagcccggctgcgtgggcgagatagcggtcggcggggacggcctcgccctggagtacctgggacggcccgagctgaccgccgagcggttcgtacccgacccggacggcgaaggccgcctctacctcagcggcgacaagggccggcagctgcccgacggccgcctggagcatctgggccgcctcgacagccaggtcaagctgcgcggtcaccgcatcgaactcgacgagatccgctcggtgctgctcacccacccctcggtgcgtgccgcggcggtcgtactgacccgccccacggacgcgaacggcgaggacgccaccctcgacgcatacgccgtactggacggggccgacgcccgcgaggtccgccggcacgccgcccggctgctgcccgagtacatggtgcccgccaccgtcaccccgctcgccgagctgccactcaccgtgaacgggaaggtggacgtggccgcgctgcccgcgccccgggccgccggcggtgaactcccttgtgtggcggacgagtccgcacagggcacgctggccgccgtgctcgccgcctggcacaccgcgttcggcgaacaggtcgcggccggcgacgacttcttcgagctgggcggcaactcactgcgcgcactgcgcgtcgtgcacctgctgcgggacgcgggcctccgtgtcgacgtgcgcgacgtgtaccggctgcgcaccccgtcggcgctggccgaggccgcctccacggcgcccgccgacgcggcgaggacggcctgacccggccgtgtaagggctttgcccgactgtccgggacgccaccggcggcgggatgttcgagacctgacaccgattcgaggagtgttcatgagcaaggtcgcggtcctcaccaatgaccttcagtacgacctggtgaacaagaaccaggagcgcatcgacgccgtggcggaggccacccccagcttctcgggcttcctcaaggacatgcgccagcgcggccaccacgtgctgcacctgcagctgatcaacaaggcggacgacccggtcgccgagcggtacgagggcggccgactgcccgcgcagaagggcacccagggcgccgagatcctgcccgtcttcctggacgacaccgacatcctcgtcgagaagaacaaggacagcggcttctacgagacggacctgcacgagcggctgcaggccctcggcgtcgagaccgtcatcgtgaccggcatgcagggccagatctgcgtgcagaccacggccgccgacgcgttcttccgcggctacaacgtctgggtccccagcgactgcgtcgtctcggcccaggagcacgacaaggtgcgcgccctggactggctggacggctactgcgcgaccgtggcgccgtccgatgagatcgtccgcgtcctcgacgccgacggcgacctgccgcgcaaggtgttccgcaccccctgagccctcggtccgcgaacccgcgaccggcctcacaggcgggcggcgcccctccccgcgccgccccctcatcaccccgcgtcaccccgcttcagccgccccctcatccgcgtacgtcttcgaccccaccgggagtcacgttgccgacggccacgacgtcctttctggaccagaaaatcgtccttgaccacgggaccggggcccggctcagccgggaactcgtcgagttcgtcgtggaggtgctcggggacgtctacctcggcgagatggaggacagcgccatcctcccgccgctggacggcgctctcgccatgaccaccgactccttcgtggtggacccgccgttcttcggcaacggcgacatcggcaagatcgcggtgtgcggcaccgtcaacgacctcgcggtggccggcgccgagccccgctacctcacgctggcgatgatcctggagagcgggttcccgctctccgggctgcaccgcgccctggagtccgtccgggacaccgcgcgcgaggcgggcatcaagatcgtcgccggtgacaccaaggtcgtcggggagggcgaggccgacggcatcttcctcaacaccaccggcgtcggcgtcttcacctccccgcccaagcgcatgaaggacgtggccgtaggcgacaagatcctgctcagcggccccatcggcgaccacaccatccacctcctctcggtgcgcgagggcctcggcttcgagaagaacgtgctcagtgactgcgccccgctgaacaacatgatcgacacggtccgcggcgcggtgcccgagtccgcggtgcgctccatgcgcgacgtgacgcgcggcggcctcaacgcggtgctgcacgagtacgcctccgccctcggtcacgccgtacgggtcgaggaggaggcgctgccgatcagcttcgagacggcgatggccgcggacatgctcggcatcaacccgatcaactgcgccaacgagggctgtctggcgctgttcgtggcgcccgagcacgcggacgaggtcctgcgcgtgctgcgcagccacccctacggcaaggacgccgtcatcgtcggcgaggtcaccgcacgcccggagccggtcgtggagatggccggcaaggacggccggatccaggagatcgaggaactgcagggcgccgagcttccccgcctgtgctgatccgaggacccgaggaggagtcatggcagagaccgagcagtggctgatccgggtgaccggggtggtgcagggcgtgggctaccggcccttcgtgcacaccctggccaccggcctgggcctgagaggctgggtcctcaacgacacgctgggcgtccagaccgaggtgtccggcggggccggcgaactcgcggaattcgcgggggcgctcaaggaccgcgccccgctgctcgcccgcgtcgaagaggtgcgggtggagtcgcggacgccccgggcgggcggtgacctgccgacgggcttcgagatccgggagagccggcgcaccgggcgggcgaacaccatcgtcgccccggactcgcacgtgtgcgacgactgcctgcgcgaggtcctcgaccccaccgaccgccggttccgctacccgttcaccaactgcacccactgcgggccccgttactccctgatcaagggcctgccctacgaccgtgagaagaccacgatggccgtcttcgcgatgtgcgaggactgccgcgccgagtatgtgaaccccgcggaccgccgctaccacgcgcagcccaccgcctgcccgcggtgcggcccgaaggtggccctgtccgcgcccgacggggtggtggccgaggccgatgaggcgctgacgcgcacgatcagggcgctcggcgacggccagatcgtcgccgtcaagagcgtcggcgggttccacctcgcggtgaacgcgcgtgacgcggcggccgtggcccggctgcggcgccgcaagaagcgggactccaagccgttcgcggtgatggccgcgggcctcgacgagacggccgcaatcgcccacatcacggacgccgagcgggagttgctgcgttccccggcccgccccatcgtgctgctgcgcaagctgccgggcgcactgcccgaggaggtcgccccgcgcaacccgaacctcggtgtgatgctgccgtcggctccgctgcaccaactgcttctcgaccggccggagtcggacgtcctcgtgatgaccagcgggaacatctccggccagccgatcgcgtaccgcaacgaggacgcgctggccgagctgttcgaggtcgccgacctgatcctgcaccacgaccgggacatccacgtccgcgtggacgactcggtggtacgcagctccgtgcacccggccctggacgagccgatcatcacgttcctgcggcgctcgcgcggctacgccccctacccggtgaaggtcgacgacatcgccggaccggtcatcgcgtacggcgcggagctcaagaccacggtcgcgctcggcgacggcaacgaggtctacgtcagccagcacatcggcgacctgaagaacgacgagacctacgcctcgcaccgcgaggccgcggcccacctcgccgaactgtacgagctgaagccccggcacgccgcctgcgacctgcaccccgccttcaaggcccgggtgctggccgggaccgaccggcccgacgacgtcgtcgaggtccagcaccaccatgcccacatggcgtcctgcatggccgagaaccggctcagcggacccaccatcggcgtcgtcttcgacggcgccggctacggcgaggacggcaccatctggggcggcgagttcctcgtcggcgacttcgcctcggtgcgccgggcggcccatctgcggccggtcccgctgctcggcggcgacaaggcggtggccgagccggtgcgcaccggatacgcgctcgcgctgcaggcactcggctcccccgagcgggccgtcgccgcgttccccgcgctggagatcctcgacgaccgcaagcgcaccgtgttcgcgaccatggccgaacgcggcatccaggccccgccggtgtccagcatgggacggctcttcgacgcggtggccgccctgctcggcgtgtgcgcctacgccgagtacgaggcacacggcccgatcgaactggaggggctgctgggccgcgacctcgccctgaccgcgccctacgccttcggactccagcaggagggcgacaccgagctcgtcgacccgaggccgctcgtgcgggcgatcgccgcggacctggcacgcggcaccggcgtcaccgacatcagccggcgcttccactccacggtggtcgacatggtcgtcaagcggtgcagcgcgctgcgcgaacgcaccggcatccgccaagtggtgctctccggcggcgtcttcctcaacgagttccttcaggtcaactgcctcgtggagctgcgcagggcgggcttcgacgcccatgcgcaccgcctggtgcccaccaacgacggcggtatcgcgctcggccaggtgatggtcgcgaacgcacgcctgcgtgccagcccggacagcacagacagcccggccaccccgaaccccggcacgaacgaatgccgctgacccgctccaccgacgacggaggcacagcccgatgcggaccgcagatctgacgctggacaccgtcgtgcgcctgctgagtgagaacgaggcgagcgcacggcagaccctgagcatggtgccgtcggagacctccatgtcggggctggccaagttgcccatgcttctcgacccgtaccaccgctacttcttcaacgagggcgacgaccccgaccgctggcacttccgtggcgcgcagcggctgcgcgacctggagatggagctgaccatcccgctcctgcaggagctgggccgggcctcgtacgcctcggtgcggccgctgagcggtctgaacgggatgacgctggtgctcggcgcgctcggcggcgaaccgggttccacggtcgtcaccgtctccccggagcagggaggccactacgcgacgccacaggtggccggccggctcggcctccatgcggagttcctgcgcggccccgacccgcactccctcgacctcgagcacgcggccgagctcctcgcccgggtacgaccctcgctggtgtacgtggaccagtcgcactgcctgttccccgtcgatgtgaagtccttggtggagacggtgcgggaggcctcgcccggcacgctggtgcacgtggacgcgagtcactggctcggcctggtactcggggacgcgttccccaacccgctggaccagggcgcggacagctggggcggctccacccacaagaccttccccggcccgcagaaggcggtcgtgctgacgcgggacccacaggtggagcagctgatccgcgacgcccaggacttcctcatcagcaatcaccacttcgccgcgaccatcgcgctgggcatatcgctcctcgagttccgcgagttcggccccgcctacacccgggcggtcctggagcacaccggccgcttcggcagactcctgaccgagcggggcctgaccgtggtcgccgccgaccgcggctactccgcggggcaccagctgtggctggacacggaggccgacggcatcgcgccgaaggacgcggccgcccggctctccgccgccagcctcaaggtcaacttcatggccgggctgccgggcttcaccgggcagggcgtgcgcatcggcctcaacgaggccacgtaccaagggctttcgggtgacgacatcgacgagctcgccgacatcttcgtggcggccgtgcgcgacaccgaaccggccgccctgctcgccgagcgcacggccgcgctgcgcacccggaccccgttcggcgcttgtgcggccgatggcagtccgctgctcgccacggctctggacctgtgcgagggcgccctgcggcgcaccggcgcggccgccgggcgtcccctgacagaggcgtcccggtgagccggccggtcatcggcatcgcctcgtaccgcgaccgcgcgcgctggaacatctgggacacggacgcgacggtgctccagcaggggtacgtcgacggggtgcgccgggcgggcggccgtgccgtcgtgctgccgcccgacgacaccgacgcggacgtggtggcccgtctcgacggactcctgctgcccggcggtgccgacgtcgacccggcgcgctacggtgccgcccgccatccgcgcacggacactccgtcggccgaccgggacgccggggagctgctgctgctcgaggcggcgctcgccgcgggactgcccgtcctcggggtgtgccgcgggctccagctgctcgccctcgcctacggcggcaccctgcaccagcatctgcccgatctggtcgggcacagcggccactgcccggccgagggcgtcttcggccggcaccccgtgcacctggtgcccggcagccgggccgccgcgctgtacggggagctggccgaggtcaactcgcaccaccatcaggccgtgctcgatccgggcggactgcacgtgaccggacgtggcgaggacggcgtggtggaggcggccgaggacccgtccaggccgttcgtcctcggcgtccagtggcaccccgaagtctccgacgaccggaagctgttcgcggcgttcgtcgcggcctgcaccacccggtcgctgcacacagcggcatccgtctgaccgcgccggcgccgtgacgccggtgcggtggcacgtgccctcgcccgaccgggccccgtacacctcaccgtaggactttgccaggagggcaaccgtgcacactcacgtccgtcccgtcggcggcacactggtcgacatcctgcgcgaccgggcggacgccactccgcaccgcaccgccctggaattcatccgcgacgacggcagcgaacacgccgtcggctacgcggcgttggaccgcagggtgcgcgccgtcgccgccgcgctcaccgagcgcggcctgcgtggcgagcgcgtcctgctgctgttcccgccgggcgagaactatgtgacggccttcctcggctgtctgtacgcgggcgctgtcgccgtgcccgtgtatgtgccgaccggcaagcgcggcctgtcggcggtccttgcgaccggggcggacgcgggcgccgtgctcgcgctgagcagccgcgaggtgacggacgcgatcacggcctcgtacccggagctgaccacgtcggggctgatccagtggctggtcaccgaggacatcgcggacgcggcggccgacgactggccgggcaccggccccgcgcccgccgacctggccttcctgcagtacacgtccgggtccaccgggacgcccaagggcgtgatggtgcggcacgacaacctggtgcacaactcggcgtccatcagcaccgccctgggcgtcggtccggacagccggggcgtgagctggctgccgccgtatcacgacatgggcctgatcggcggcatcctgcagcccttgtacgcgggtttcccgtgcaccctgatctccccgatggcgttcgtacgcagcccgtaccgctggctcgacgccatcagcaggcaccgcgcgacggtgtcggcggcgcccgacttcgcgtacggcgagtgtgtgcgccgcattcccgaggacaagcgcgccgagctcgatctgagcagctggcagcacgccatggtgggtgccgaacctgtgcggcccgcgaccctggacgccttcgcgcgcgccttcgcggacagcgggttcgaccggtcggccttccacccctgctacgggctcgccgaggcgacgctgttcgtcaccggcggcgcgcccgagcggggcgaaccccgggtgctgcgcgccgaccgtcgcgaactggagctgggccaggccgtgtcggccatcgcgggcaaggagaacaaggagaacgctgctgtgctgacgggctgcggccggtcgcgcagcgaggacgtcgtcgtggtggtggatccggccgagggccgtgcgtgcccgcccggcgggaccggcgaggtgtgggtgagcggcccgaccgtcaccgcgggctactggggccggcccgagctgaccgacgaggtcttccgcgccaccctggagtcccacccggggcggcacttcctgcgcaccggtgacctcgggttcgccctgggcgacgagctgttcgtgaccggccgcgccaaggacctcctggtggtgcgcggccgcaaccactacccgcaggacatcgagcagagcgccgagcacgcccacccgctgctgcagccgacccgggcggcggtgttctcgcacgacgacgggaccgaggagcgggccgtcctggtgcacgaggtggtccgcggcttcgaccccgaacgcgcccccgaggtgatcacggcggtccgcaaggcggtgacggccgaacacgggctctccctgcacgaggtggtgctggtgcggcccggagcgattccgcgtaccacgagcggcaaggtgcgccgcagcacctgccgcgagcggtggctggacggcactctgcagccgatcgcgaccggcggcgcggacaccgcgcccgacgccgggggcggtgacatgcccccggtgtcgagggcggtcgccgaggtcgtcgccctggaactcgacgtgcccgccgaacagctgccgcccggtgtgccgttggtggtcctcgacctcgactcgctgcgggccgtgcggctcgccgaagcgatgcgtgagcgcttcgggctccgggtgtcccccgccgagctcctcgacgggctgacgcttgcgggcctgagcgccctcgtcgacgccgtcgacgacgtggccgaggcacacgtcggtgccgacgacaccgaggccgccgacgcgcccgcgagccgggcccaggagtggatgtggctcctcgacgccatgggcggcggcgcggcgtaccacgtggcgggcggcatcgacctgcacggccctgtcgacccggagttgctgcgcgcgagcctggaggacctggtggcgcgccacccggcgctgcacagcggtttcacctccgaccccgatggcaccctgcggcgcacgccgctcgcccctcgctccttcgagctgccggtggtggagccgagcgcggaccgggacgcccgcgcagtcgcggccgaactcgcccgggagccgttcgacctggcggcggggccgttgctgcgcgcggtcctcgtgcgggccggcgagcacgagtggacgctcgcggtggccgcccaccacatcgcggtggacggctggtcactgggtctgctgctgcgcgaactcgggatctgctaccgcgaccggctcgcggggcgcagcccgtcgcgcaccgtcgtcacggttcccgcgccgaagagcgcgggcgacgacgcggaggccgccgcgttctggcaggagaccctggccggggcgcaggcggtgtcgctgccgctggacccggccccgcacccgagccccttcaagggctccgccctgcccttcaccctgcccgcgccggtggtggcccggctcaaacgctatggggccaagcgccgttcgaccctgttcatggtgatcctcaccggcctgtccgctgtgctgagccggtggaccggccagcaggacctggtggtcggcgccgttacggccggccgccaccgtcccggcagcggtgacctggtcgggctgttcgtcaacaccctgccgttgcgcgtcgaggcctccggtgaccccgccttcggcgagctgctgtcccgggtccgctcctcgtgcctggccgcctaccggcaccaggacctccccctcgaggagatcgtccggctgaccggcgcggaccgcgccgacggacgggccccactggtgcgcgtggcgctcgccctgcagaacctgccggtggcaccctggcagtccggcgaggtgcgcgccgagcccttcgagctcccttctcccggcgcgcagttcgagctgtcgctgcatctgacggaggagagcgacggcagcctgacgggccacgccgtccacgcctcggacctgatctccgcaccgagcgcgcgccgcatccttcaggccctgacgctggccctcgaagccgtgccggggccgccgggggcggcggcgacagatcttccgatgctcgccccgcacgaactcgaccgggtggtgagcgagttcagcggctcggacacgccgctcgacgacggcctggtgcacgccggtttcgagcggcaggcccggctcaccccgaacgcaccggccgtcgtgtgggacggcggcacgctgtcgtacgcacagctggacgcccgggcgaaccggctggccaggcggctgcgctccctgggcgcggcccccgatcaggtggtggcggtgcacctgccgcgctcccccgagctggtcgtcgcgctccttgcggtcgtcaaagcgggcggtgcctatctgccgctcgacccggaccacccgcgcgcccggctcgccctgcaactcgccgacgtgaccccgtcgctgctggtgacgtcgcgggatgccgcgcacggcagagcgggcgaactcgcggcaggctcgcccgggctgacgctcgtcgagatcgacgacccggccctggccgaactgccggacggccccctcgacgaggtcgcgcggccggacaacctgctgtacgtcctgcacacctctggcacgacgggcacccccaagggggtgatgaaccggcatgccggcgtggccaaccggatggcctggatgcaggagaagtatccgctcgtggccggggagcgcgtgctgcacaagacgcccgtcgggttcgacgtgtccggctgggagatctggtggccgctcggccacggcgcgacgatcgtgctcgcccggcccggcggccaccaggatcccgggtatctggtgcggtccgtcgtcgaccacgcggtgacgacctgtcacttcgtgccgtccatgctgcgcgtgttcctcgacgaaaccacggccgcgacggccggggggacgctgcgccgggtcgtgtgcagcggtgaggcactgccgccggacgtggccgcgcggttccaccgtctgctgccgggcgtggagctgcacaacctgtacgggccgaccgaggccgccatcgacgtcaccgcggagcaggtcgagcccggcgcgaccgaccggccccggctgccgatcggacgcccggtgcccggcgtacgcctgtacgtgctggacggacggggcaatcccgcgcccgtcggcgtacccggcgaactgcacatcggcggcccccaggtggcgcgcggctacttcgggcggccgtcgctgaccgcggccgccttcgtccccgacccgttcggctccggggggcggctctaccgcaccggcgaccgggcgtgctggaccgaggacggcaccctcgactacctcggccgcatcgaccaccaggtcaagatccgcggccagcgggtggagcccggcgagtcggaggcggtgctggccaggcacccggccgtcggcgacgccgtggtcgtgccccgccggcaaggcggcgagacgtatctggccgcctacctggtggccgtggccggcgccgagcagccgggcccggcacacctgcgggagcacctctctctcagcctgccaccggcgatgatcccttcggcgtacacatggctggacgcgctgccggtgggcgccaacggaaagctggaccgcgacgcgctgccggagccggaccagaacctcgccggcggcgagcacgtggcgccgcgcgacgcggccgagcagcgggtggccgaggtgtggtgcgaggtcctgggcctcgaggaggtctcggtgacagccgacttcttcgcgctcggcgggcactcgctgcaggcgacccggatcgcgctgcggctgcgcgaggcgttcggggcggagttctcggtcgccgacctgctgaccggagtgcccaccgtggagcagacggcacggcttttgacgcagcgtcaggtggcggagagcgacccggaggagctggcccggctcctcgaccagttgtccgggctgtccgacgacgaagtggccgacctgctgcagcagcaaggctgacggtggggaaaggagacgccggcccatggccgtgacactcaaggacgacttcgccgagcgggcccgcctggaggcgcggctgctcgcccggcgcagaggcggagcggcgctgccgctgctcgaccgcccggccggggccgagtggcacttcgccgcctcgctgggccaggaaggcatgtggccctccctggcgacgacagcgcgccagcccctgatcgtgggcgggctcagggtgtcggggccgctggacaccggggcgctgcgcgaggcgtggcaggctctcgccgagcggcacgagacgctgcgcagcgcctatcggagggtcgacggcgcgctgacgcaggtggtcccggtccgcgcgaggccggtcatggacgtggccctggccgacccggcggcggccgcctcggtcgcggacgacgagcttgcccgccccttcgacttcggccggggccccttggcccggctgcgcgtgctgcgccgcgcctccggtgaacatctcgtggtggtgtgcctgcaccacctggtcggcgacgcccgggccctcgaggtggtcaccaccgagctcaccgcgctctatgccggcgccgtcacgggctcgcccgtacagctgcccgaactcccggcccagtacgccgacttcgcggcctggcaccggtcgcgcgtcgaaggtgagcacggcggacggactgtcgcgtactggctggaccgtctggccggcgccgaacccgcggcgctgccctgcgaccggtcccaggacccctcggacatcgcgggtcacacccggtccttcccgctgccgccggagctcttcgcccggctgcgcgaggtggcggcccggcaccgcaccactttctacgtggtcgggctcgcggccttccagatcctgctcgcgcgctggtcgggcgagcgggacatctgcgtgcgggcacccgtctcctaccgcgaccgcagcgaggtgcacggcctggtcggcgacttctccaacgacgtggtggtgcgcgccgacctgtcgggacacgtgacgctggccgaggccgtggagcaggtgcgggcgagcacggccgacgacttcgcccaccacgacgtaccgccccacgtggtggcctcgcgcatggccgatcccaccctgttggagcggctgttccacgtgcagttcaccgcggaacgcgagcacgacctcggcgccgcccggcagctgggcccgatacgcgccgagccgttctcccccacggccgaatccgtcgcgcgcccgctcagcgtccgcctgcgccacgacgaccacggcggccgcgtcatcgtcgcctaccgctcgggcctcttctccgacgagcgtgtacgggcactccagcgcgactatttcgccctgttcgaggagatcgcggcacatcctgggcagccggcggtgagttgacccgatgctcactcctcggcagccgatcgggccgggtgttcaagagtgagcggagttcggcgggcggaagggtcacgctcccagtgcgaggaggccctcatccgaggtgcccggttgctgtcgcggaggagtgggactcatgtcggctacgaggcgggtgcacatctaccctttcgagggagaggtcgacggccttgagatccacccgaagttcgcggaactgagggagaccgacccgctcgccagagtgcgcctcccgtacggcggcgaggggtggatggtcacgcggtacgacgacgtgcgcgccgccaactccgatccccggttcagccgcgcgcagatcggtgaggacaccccccggaccacaccgctggcccgccgcagcgacaccatcctcagcctcgacccgccggagcacacacggctgcgccgcctgctgtccaaggccttcaccgcgcggcgcatgggcgcgatgcagtcctggctcgaggaactgttcgccgggctcctcgacggcgtggagcgcacgggacatccggccgacatcgtgcgggacctggcccagccgttcaccatcgccgtgatctgccggctgctcggggtgccgtacgaggaccggggcaggttccagcactggtccgaggtcatcatgtccaccacggcgtacagcaaagaggaggcggtgtcggccgacgcctcgatccgcgcgtacctcgccgacctggtgtcggcgcgccgggccgcgccccacgacgacctcctgggcgtgctggtgtccgcccgggacgacgacgaccgcctcaccgaggacgagctcatcacgttcggggtgacgctgctcgtggccgggcacgagacctcggcccatcaactgggcaacatggtctacgcgttgctcacccacgaggaccagctgtccctgctgcgggagcagcccgagctgctgccccgcgcggtggaggagctgctgcggttcgtgcccctgggcaacggtgtcggcaacgcccggatcgccctggaggacgtcgagctgagcggtggcacggtgcgcgcgggtgagggtgtcgtggccgccgcggtgaacgccaaccgggacccccgggcgttcgacgacccggaccgcctcgacatcacccgggagaagaacccccatctggcgttcggtcacggggcgcactactgcctcggtgcccagctcgcccgcatggagctgcgggtggcgatcggcgggctgctggagcgcttcccggggctgcggctcgcggtgcccgcggaccaggtcgagtggaagaccggcggactgttccggggcccgcagcggctgccgatcgcatggtgaggggaaccggcatggcacgggagcagaacacacgctggcggatcgaggccgaccacggcgcgtgcatgggcaccggcatctgcgccggtgtcgcaccggacgtcttccaggtggtcgacgggcggtccgtaccgccggccggagaggtgccggcggacgagaacgtgctggacgcggtcgagtcctgccccatggaggcgctgcgggtgcgggacgcggtgagcggcgaggtgctcgacctgtcgtgacggtgcgggcctgcgcggcgcttctcaagtggctctccagcggaattcgagtggggtgtggcaggaaaggactacggtcggacgggtatgggcaccgcccggctggagacgggtcccgcggtacgccgggaattcgcccacgtgtgccaatccccttgcgccgcaatccagttgcacgacttgcgccgacttgacacgattcatggggacatatgagtatccctttggattcaggaattccgtattccggtccggtttttcgcacattgcgacaaggagagcccgaatgaagttcgcgatcgtcatcatcgagaacgccgagtcccggcgtcagatccaggaggaccgcgcgacctaccgcaaggcgatcgagggctggatgggccagcaggcccaggccggtgccctcgtgggcggcgaggcgttcgagaccgagtccctcgccccggtgacggtgcgccgggaggccgacggcacccgtaaggccgtcgagggtccgttcgcgggcgccgacgagacgctgggcggttacatcctcgtcgaggccgccgaccgcgacgccgccgtggagatcgccaagtcgtggccgaaccccgagaccctcgaggtacggccgctgtgggtggccgagtaaccagccggtcccaccggctccgacccgcgtccgggcacgcccggccgcgggttcaggcctgtaggcgctatggagaggcactcgccatgacggacggcgcgatacacacacacgcggcgggagacggcgcgggccggctgcggccccttctggacgccgtgcacgacacggcctgcgaggtacgggcccgccgccccgactacttcgagcaccggccgctgcgactgcccgcggaactgctcgcgcaccacggcaccacccccgccgcactcgcccaactcatcggtgattcctatgagttgacggtcgaaccggtcaccgaccccgcggactgcacctccgtggaccgtctcgcggccgcccgcgcacagcacgccggcaccacgcccggcgacagcggcgcccagcgcgcgccgcagcccggcgaactggcggccgtcgcccgcgagcagagcgagctgcgccgcgccgccgagcgggacgccgcgcggatcggtgcggcggcgccgttgcgggtcggggtgctcggcggcgtgctgccgtacaccgcggcgggtgtgcgcgaggagggcgagccgcccgtcgtcctggtgaacgcgctcggcatggggaccgcgctctggcaccccctgatggcggctctcgcacccacgcgccgcgtgctgacctgggcgccgcggggcaccgcggcgggcacccggccgatgcgcctgcgcgaccaggccgacgacctggcggcggtgctcgccaccgaaggcgcccgggactgccatctggtgtgctggtgcagcgggcccaagacggccatggagttccgtcggcgccgccccgagtccgtgcggtcgatggtctttctgcacggctccttccggcacacgggcgatccggccggcctcgaacccgacacgccgtacgagcgcaatctcgaggagctgtgccgcgccgtcgtcgcccggcccgccctcgcggcccggctgcgcaccatgttcaccggtcaaccggccgagatgtcaggggacttgaccgcccatcggttcgccgacgaggtcctcgcgctgcccgcgcccgccctgggcggcgagctgctgcgccccttctcggacgacgccgtcctggtcgcctatgcccgccagctcctggactactgggcgtacgacggtctcgcgcacgcggccgacgtacaggtaccggtgctgtgtgtgagcggcgagttcgaccggatcgcctcgcccgagcggctcgccctggccgcggaccgctttccgggcgcccgccacgagcgcctggccggcgccacgcaccactccatgtacgaccgcccgcgcgaggtcgcgcggctgctcacggacttcttcacggaggcggttcggccgcgctcaattgtgagcggcgccgcacggtgacgctgcctagcgtcggacaccaggggtcccaaggcctcttcaccagtgcgacgaaggagacagagcgatgaccgacgcggcgagccaggcccagggcgcgtttcttcccgcccacagcgggcctctcggttccggctcagacctgctgcactccgggaacgcgggcttcatcatccaccgggccggccagctcaaccacgcgttccgcgcccaggggcgtcagttcgccacggatctcgtcggccacctgaacaaggtggtggagggcgtcgccacgatcgtggtgcacgaggagatcctcggcaccgccgaccggctccactggctgatccacatgaagcagcccaacgactacagccgcttcctggagatagccgaccacgaccgcagcttcaaggagatcaccgaggccgaccggatcgcggccgcggagggcgccggcaactgggagcgcatgttcgtcgagggctccttccaggagcgggtgtacgtcccccagcacggcctggacgagcacgacgacgaccacgaccacgaccaccacgacgagccgtcggacaccttcgtgccgcccgcccgccaccagaccgggctgcccgacagccggatgcgcagctccgtggacagcggcctgacgatcatccgtacggcgcagaccgcgttccgcttccgcaccgaggcccgcgagttcgccttcgcctgggcctccgaggtcaaccgggccctcggcggcgagctgacggtctacctctacgaggagacgttcggccagcaggaccggatccactggatgatccacctcgacagcctcgacacctaccgcaagctgaccgagctgagccgccacgacgccgactaccaggcgctgttcgggcggcagttcgtgcccgacttcaagggcggtggcggctgggagcagacgttcgtgtcccccaccatccaggacaccgtgctcacgccgctgcaccccggcgcgcccgcctggttctgagcgggacggacgcagccgtgacggccatcggcccgacccaccgcggcgtgcggctcactgccgagccgcacgtcctgcgcgccactctcaccagcccggacggcctcaacagcctgagcggtgctgccctggacgcgctgggggccgccctggaccgggccgaggccgaccccgagtgccgtgtcctgctcctcgagggctcgggcggcaccttctgtacgggcctcgacttcgaggaggccgccggcgatcctgcgggcggcgcctcgcaggccggccggggcggggccgagttcctggctctgatgcggcgcttcggcgagacgccgctggcggtcgtggcctgcgtcgacggccgcgcggcgggtggcggcgtgggactcgcggccgccgcggacctggtcatcgccaccgagcgcagcgagttcagcctgccggaagcgctgtggggcctggtgccctgctgtgtgctgcccgttctcgtacggcgtaccggcttccagcccgcgtacgcgatggccctgagcacccagccggtgtccgcgcgccgggccgcggacttccgcctggtggacgaggtggtgccggacccggatgccgcggtgcgccgcctcctggtccgtctcacccggctcgacccggcgacgatcggcgagctcaagcagtacttccgggccatgtggttcaccaccgaggacaccgacgcgttcgccctgcgtgagttcacccggctcatcgactcgcccgtcgcgcgacgccgtatcaccgactacacgacaacgcggcggctcccctgggagaagccgcggccctgaccggggccgaagccaggagggacgaggcgatggtggcactggttttcccgggacagggatcgcagcgcaagggcatgggggccgacctgttcgcccgcttccccgacctgacgcggcaggcggacacggtcctcggccactcggtggaggaactgtgccgttcttcgggcgacggcaggctcgaccgcaccgagtacgcgcagcccgccctgttcgtggtcagcgccctgtcgtatctggcccgggatccggggctgccccagccgacgttgctggccgggcacagcctgggcgagtacggcgctctgttcgccgcgggctgtttcgacttcgccaccggggtacgcctcgtccgcgaacggggcgccctgatggggcgcgcccagggcggtggaatgctggcggtgctcggcgtcgacggcgacgaggtgcaggcgctgctcgccgggaccggggcgcgccaggtcgatgtcgcgaactacaacacgcccacccagacggtgctgtccggcccgctggacgaactgcgcatggtctccgcggccctgggacaacggccgggggtgcgatgtgtgcccgtgcgggtgagcgcggcgttccactcccgccatatgcgccccgccgcgcaggaattcgcgacgttcctgaccgggttctccttcgccgatccgcaccgcacggtcatctccagcgtgacggcacgcccgtacggggcggggcaggtcgccgagctgctgtcccgtcagatcgagagccccgtgcggtggtcggagaccatggcctacctcagggagcgcgggacgacggagctggaggagatgggcccgggcaaggtcctgacgggcctgtggaagcagggccgtgccgacggggcgaaggcccgggccgtggcgcccgcaccggtagcggtcgtggccggtgtccccgcggcggccgcggcccgggcgcccgcttccccggcgcctgtggcggcgcgggcagcgactgcggcgcccgcacgcccgtcggaccccgctcccccggctccccgcaccgccccctcccccgcctcgcccgtgccccccgcctccgtttcgcgcgggcagcgggccgaggaactgggcagtgccgagttccggcaggactacgggatccgttacgcctatctcgccggggccatgttccgcgggatcgcctcggcggagctggtcatccgcatggggcgggccggtctcatggggttcttcggggccggcgggctcgggctcgacaaggtggagagcgccctggtgcggatcaaggacgcgctcggtccggacggccggtacggcatgaacctgctgcactcgatcgacgacccggcgtacgagcacgccgtcgtcgacctgtgcctcaagcacggtgtccacgacgtggaggccgccggattcacccaactcaccccggccgtcgtgcagttccgattctccggtgcccaccgggatgccgcgggccgcgccgtcgccgtacgccgggtgctcgccaaggtgtcgcggcccgaggtcgcggccgccttcatggcgcccgcgcccgcggcgatcctgcgccggctgaccgccgacggacggctgacgcctcaggaggccgagatcgccgccgagctgccggtcggccaggacatctgtgtcgaggccgactccgggggccacacggacggcggcgcggccctgacgctgctgccctcgatgatccgccatcgcgacgcggcgatggcccggcacggttacggccggcggatccggatcggcgcggccggcggcatcggcgctcccgaggccgtcgccgccgcgttcgtcctcggcgccgacttcgtgctgaccggcagcgtcaaccagtgctcgcccgaggcgggtacgtccgacgccgtcaaggacatcctggccggtctcgatgtgcaggacaccgcgtacgcgcccgcgggcgacatgttcgagatcggggcccgggtccaagtggtccgcaagggaacgctgttcgcggcgcgcggcaacaagctgtaccagctctaccgcagccacgacagctgggagtcgatcgacgcgggaacccggcgctccgtcgaggagacctacttcaagcggccgttcgccgaggtgtgggaggagacccgcgcctaccacctcgggcgggggcgcgacgccgagatcgagaaggcggaccggctgcccaagcaccggatggccctggcgttccgctggtacttcgcccgctcggtgcgctggggcctggagggcgaaccgacgcagaaggtcaactaccagatccagtgcggcccggcgatcggcgccttcaaccacgtggtgcgcggcaccggcctcgaggactggcgtcaccgccatgtcgacctgatcgccgaacacctgatgacgggcgccgccgacgtcctcgcccgccgctgaccgtgcgccgcccggcagcggcggacggcgggcggcacacgtatcgatccaccgaaccctggagccaccatgaccaccctgaccttccactcgaccaactccggtgtgatcgtggagcgcaccgcccagctcaagcaggcccatcgggccgagggccgccggatcgccctggagcaggccgcgtacctcaacgacaagttcgcggggcagaccacggtcaccgtgcacgaggagacgttcggcgtccgggaccggctgcactggctggtgcacctgcccaagctcagcggccaccgcgagatctcccggctgctcgacggcgacgaggggccggccgcggacgccgactggcacgggatgttcgtcgacggctcgttctcggagacggcgctgatcccgcagcactggggcatgtacggcaccgacgaggcgctgcccgagggcaccgtcatcgacgccgccgcgcccgacctgcgcgtcccgccggcccagcggcagacctcgatgagcccggagcgcaccctcaactcgtccggcgcgggactgatgatccaccgcgtcgcccagcccaagtacgccttccgcgccgaggccaggctcttcgcccgccgcatcaccgagtcgatcaacaccaggctgcccggcatcgcgtcgtcgttcctgtacgaggaggccttcggcccggccgaccgggtgcactggctcatccacatgaagtccgaggacacctactacgacctgatcgacatgcacatgcgcatggacgacgcgacccgcgcgatctatctggacgagatcatcgcgccggagaagggcggcggcacctggaaccggctgttcgtcgaggagagcatgggcgacatcgccttctccccggtgccggacgcccgctagagaaacgctcgcttcgccgcctcaccgcctcgccacccgcgggcctgctcacttctgagcaggcccgcgggtgcgctgttcctagggtgcgtcaggtgcagcaagccggtgtcttttctgggggagcggatatggagcctggaaccagcccgtcggggcagcaggatgcgtccggcctcgccgcacgggtgacggccgtgatggtgcgggtgctgtccgcggcccggcccgacgcgcagcccgtgaccgccgcatgcgaactgcggggcctcggcctcgattcgatgacggcggcccggctgtggctcgcggtgcagggcgagtgtgcggcggatgtgccgctgggctggctcaccgaggcgaccacggtcggcgagtacgcccagcgggtcgccgaccacgcgtcgcaggcggtgccggtccagggggcgggtgccgtcggagcacaggtcgccgcggacccggacgccctgcacgagccgttcccgctgacgccgctgcaggaggcgtatctcatcggcaaggagcccgagctgcaggcggacgccgtgggctgccacctgtaccgcgagttcgacgtgccggcgctcgacaccgagcggctgcgcgccgcctggcagcgcctcgtcgagcaccacgacatcctgcgcgccaccgtcaccgaggacggccggcagcagataaccgcgcaggccccgcgctgggacctcgccgtgcacgggagcgccacgcgcgccgagttcaccgagaccgcgaccgccgtgcgcgcccggatgtcccaccacctcttcccggcgggccactgtccccccttcgcgatcgaggtcaccctcggccccgacggcaccggccgcgtccacttcggcatcgacgcgatagtcaccgacggtcagggcctcgacctgctcaccgcgcagtgggaggcgtgttacgccgacccgtcccacctccttcccgcaccgacggccccgctgtcggtgcgggactgcgttgtggccctggacgcggcgcggcggaccgaggcccaccggcgtgacctcgaccactgggtgcgccggctgcgtgaactgccgggcgcgccgggcctgttcacggcggacgcgccggagcgcggcaccggcctgtcgtgtgtgcgccgcagcagccgcaccgcgcggctgacggccgccgagtggcggtcactgcgcgcgagggccgaggagctggcggtgtcgccgacctcgctggtcctgaccgtgttcaccgaggcgctcgcccggcacggcgcccacgagccgttctccctggtcgtcaccaccagcaggcgccctcaactgccgccggaggccgaccacttggtgggtccgttcacgggcaccacgttcgtcgaggcggtgcccccgcagcagcacacgttcgaggaggccgcccgtctcacccacgagggcctgtggcaggcactggagcactccgcggtctgcggggtcagcgcgcagcgggcgctgcgcggcggcggtcccgggccgctgcccgtggtgttcaccagcatgctcgacgcggcgggccggccgagggcgcgcgggttcgcggcggcgccggtgtacgcggtcagccagacctccggggtgtggctcgaccaccagatgtgggagcaggacggcgcgctgcacctgcgctgggacaccgctgacgggtgcttcgcgcccggtgtggtggaggccgcgttcgcgtcgctgtgcaacgggctgcgcgcgctcgccgtcgcgggacccgtcgtcacccgccccctgaacgacctgcagcaggcgtacttcgtggcgcgtgccgccggggagccggggccgtggcggggctgccaggtcgtcgtcccgtacgacaccgacgagcgcgtggacccggtgcgtctggagtcggccgtggtgcggctcgtcgaggcgtacgacgtgctgcgctcggcggtcacgcaggacggcgtcgtggaggtgcgcgccggggcgccgcgccggtggacggtgcccgtcgtcgcgggcggctgccccgatgaggtgcgcgatgccatggcggcggcgaacttcccgctcggccggtacccgcagttcgaggtgcgggtggtgcgcggcgacgacggtgacacggtcctcatgtcgatggacctcacgctcaccgacgcccgcggcatccatctgaccggccgtgaactgatgcgcctgtacgccgatcccgcggcggagccccggcccgccgaggcggctcgggactcggcgcgcgacgcggacgagcaggcccgctcgcgggcccactggcaggaccggctgcgggcgctgccgcccggtgtgccgctgcccgggccgcgtgacgcggacgggcccgaccgccgggtccgcctggccggcgcgccgctggcgctgcggccgctcaccgaccgctgcgccgagcacggtctgagcctggacgcggtgctgctcaccgcgttcaccgatgtcctcgcccgcacgtacggaacggacttcgccgtgccggtggtccgctgggaccacggtctcgacccgcagcggcccggcgagttcacggcgctgagctggctgccgtgcgcgccgcgcgagctgtccttcaccgcgcgggcccggacctaccaggagggtctggagcgggacgccgatgtgtccggcagcggtcttcccgagctgcggcgggccgtggcgcgctccggtggcgccgggtaccccgtcgtctacacgtgcgccctggacctcaccgaccggccgctgccggggtcggtccgggccgggcagtggctgagctgtaccccggacgtgttcctggactgcatcaccaccgtcgacgccggccagctgcagctggcctgggacgccgtggacggccgtgccccgcaaggcggctggagcgagctgcacgccgagtaccgccggtccgtggcccgtctcgccgacgacgcggcggcctggcaggagccggccgggggcgacacgtcgggcgcggacgacggcgaggtgcgcggcgccgagctgcacaagatcctgcacgaatggaacgacaccacccgcgcgttccccgacgaccggctgatgcaccagctcttcgaggagcaggcggcccagcagcctcgggcggaggcgctgcgctggcgcggcggcggcacgatgacataccaggagctgaaccggcgggccaaccgcatcgccgcccggctggccgccgaggacgtgggcccggagacggtcgtcgccgtcagtgtgccgcgcgggcccatgatggtcgcggtggtcctcgggatcctgaaggccggcggtgtctatctgccgatggagccgcatctgcccgccgagcgggccgccgtcatcctcgaggaggcgcacgccgaggtcgtcgtcaccaccgccgaccgcgagggctggccggtgcccgacggatacgcccgcgtgtgcgcggacgccgccgtggagggcccccaccccgccgacgcggacaactgcccgcggcccgtgacgcagccgcacaacacggcgtacatcatcttcacctcgggcagcaccggccgccccaagggtgtggcggtcgcgcaccggcccgtcctgaacctcatcaactggtgccggcgcaccttcgggttcgggcccggggacatgggcctgtgtgtcacctcgctcggcttcgacctgtccgtgttcgacgtgttcggcctgctcggtacgggtgccgcgctctacatcgcggacgcggagcagcagcgcgatcccgctctcctcctggacgtgctgatcgaggagccggtcaccttctggaactcggcgcccaccacgctcgcccaggtaggtccgctgctcgacacagtgggcacggcgggtaccggtgatctgcgcctggtgttcctcagcggcgacttcacgccgctgcccctccccgacgaggtgcgcgccgtcttcccgcgcgccgacatgatcagcctgggcggtgccaccgaggcgacggtgtggtccaactggttccgcatcggggcgatcgacccggcctggcgcagcatcccctacggcaggcccatcgacaacagccgctaccacgtgctcgacgaggcgctgcgcccctgtcccgtcggcgtcgagggggatctgtacatcggcggtgagtgtctggccctcggctacgtcaaccagcccgagctgaccgccgaccggttcatccccgacccgttccacgaggaccctcaggagcgcctctacaagaccggtgacagggccctgtactacccggacggcaacctgagcttccaggggcgggccgacggacaggtgaaggtccgcgggttccgggtggaactggccgagatcgagcaccggctgcgggcgcacgacggggtcaaggacgccgtggtcctggcccgggaggacggctgcggggaccgcaccctcgtcgcgtacctcgtggccctgccgggttcggcgccttccgggcgtgaactgcgcgggttcgcggggcagacgctgccggagtacatggtgcccaacttcatcggtttcctggccgggttcccggccaccgccaacgggaagctggaccgggccgcgctgccgtggccgctggccaaggcacacctgacgccgccggaccgctctgccgacgccgatcccgtcggttcggaggccgaagcggccgtccctgtgaaggagtcggcggctgagcagcctgccgtcgcgggcggggccgggccctcggtttccgtgccgtcgcgcgacgagctgtgcgcggagatcgccgatctgttcgcccaggccctcggggtcgagtcggtggacgccgacaccgacctgtgggaccagggcgcgacctccttcaccatggtccgggtctcgggctccctgcagcgctcgtacaagcagcggttccccgtctccgcactgctcgacaacccgagcgtcagcgcgatcgccggctgggtccatgcgcagctggggggcggcgccgacgcggagagcacggccgccgccgaggcggagaccgcgacgtcggtcgatgccgagaccacggcgacgaccgtcacgcagaccacggcggcctccgacgaaaggcccgattccggccccggaccggtggacttcttcgccaccgaggagcgcgagcgcttcaagcgacagcactggaaccggcgccccgacgagcccgggcttcccgaagtgccgctgggcgacgcccggttcgaggacgagctccacgcctggcgggccagccgccgggacttcctcgaccagcccgtgccccaccggtccttctcgcgtctgctcggcctgctgcgcgagaccaccggcgccgacggcaccggcgccctgtacccgtcggccggcgacacctactccgtccaggtctatctgcacctgacgccggacgccgtcgagggcctcgacgccgggctctactactacgacccgtcccggcactcgctgcgcctgctgcggtccggtgtcctgccggatcgcggggcccacttctactacaaccggccggtgttcgaccggtcccggttcggcatctacctgttcggccagcgccacggcatcgagccgctgtacgccgaggagagcctgcgctacctcacgctggaatccgggtacatgagccagttgctgatgctggggcaggccgcccacggtgtcggcctgtgtccgatcggcgccctgaacaccgagcagttgagccagtggctcggcctggacgagggccatgtcttcctgcaggccttcctcggcggcgcggcggaacacccgcagcgcacggcgggcggcacggtgccgttcttcaccgagccgaccgacagcgacggcaacagcgggagcggcgacagcagcaccgtcatcaccgatgccgtggcgccggtcagcgccgccgccgaggacgccgacgccgaacccccggcgcacaccgccgagccggccgcggtgatcggcatggccggccggctccccggggccggggacctggacgccttctgggacaacctcgtctcgggccgtaccgcgatcggcccggcgcccgcgtcccggccggagacggcgccctcgggggcccgtgccaccggaggtttcctgccgcacatcgaccggttcgacagcctgctcttccatgtgtcaccgcaggaagcgccggccctcgacccgcaggcacggctgatgctcgagagcgtctggcagtgcctggacgacgccgggcacacagccgactcgctgcgcaggtccgccgggcgcgtcggggtgttcatcggctccatgtggcacgactaccggcagcagggcgccgaccggtggaacgggggagacagcgcggaggtcgcggcgaccgcctccgacatcgccaaccgggtctcgcacttcttcgacttccgcggccccagcctggccgtcgacacctcctgctcgtcgtcgttcgccgcgctgcacctcgcggtggagagcctgcgtcgcggcgagtgcggagctgccgtcgtcggcgccgtcaacctgctggcccacccctaccactggggcctgctcgacggcctcgaactgctcgcggccgacgccccgccggccgcgtacgccgccgaaggcagcggctggcacccgggcgagggcgtcggggtactgctgctgcgcccggccgacgccgcccgccgcgccaaggacaccgtgcacggcctgatcgagggcacccggatcggccacgcgggccgcgcgccgcgctacggcgcgccgcacaccgcggccctcgccgactcgctcgcccgggccctggccgacgcgtcggtgatccccgacgaggtcgactacgtggagtgcgccgcggcgggcgcgggcatcgccgacgccgccgagctggaggcactgggctccgtactcgcccgctgcgccggagcgtcgcccgttccggtcggcacgctgaagcccaacatcgggcacctggaggccgcttcgggtctctcgcagctcatcaaggtgttgctgcagatacgccacgggcgcatcgcgcccacgctggtgtcgggcgagctcagcccgctcgtggactgggacggcctcccggtcgagctggtcgacactccgcgcgcgctcacgccgcgcgccgccgacggccgggccaccgtcctggtcaacgcggtgggcgcgaccggttcgtacggccacgtggtggtgcgagcaccgcacgcgcacggcaccgggcccgccgcgcaggacggactcgcaggggccggggccgcgccgtcggcgagtggtccgcgcaccgtcgtcctgtcggccgcctcgcccgaggggctcacggcggcggccgggcggctgcgcgaccatctggccggggcgggccgcgccctgtgcctcgacgacgtggcctggacgctgcagaccgggcgcgcgtcgctcggtcaccgtctgacgctgtccgccgacggcctggacggcgtgcgggcgggcctgaccgcgttcctcgacgggcgcgcctgtccgggcctcgcgaccgccgccgccgatccggcgctcgccggagtacccgccggcgcgcaggacctggcgcgggccgccggggactggctgcgcgggcacgcggtggacttcgcccggctgtggtccgcgcccgcccgccgcgtcccgctccccgtccaggacttcacggtcctcgcgcaggagcggcactggctcgccgcgcccgcggcccggcggccggacggtgcggcgggttccgcaccggccgcgccggagtccgggcagtccgcgccgccggcgtccccgcaggttcaggacgaccgcgcggaccgcgcccaggagcatgtcgccgcctgcttcgccgaggtgagcggcatccccgccgagcagctgcacccgcgggtcccgctggagcactacggcctgagctcccgcctggtcgcccggttcaacgagcggctgcgccaggacgtccaaggggtgtccagcacggtcctgttcgagtatccggacctggccggggtcgccgcgcatctggcggcccaccacgagggcccctggtcggccgccccggacacgcagccgtcgccgcccgtcccgtccccggacccgctccccgtgccccgtacgcccgcggcggccctgggcgaaagtgccgcggccgacggtcccgagcccatcgccgtcatcggcatcgcgggccgctacccgggggccggggacctggagacgttctggagcaatctggccgaaggcgtcgacagcgtcggtcccctgcctgccgagcgcgcccgcgacggctggcccaccgagcagatgtggggcggcttcctcgacggtgtggaccggttcgacgcgctgttcttcgggatcgcgccgcgcgacgcccagctgatggatccgcaggagcggcagttcctccaggtggtctgggagaccctggaggacgcgggctgcaccagggcccgcatacgggagcaactgggctccgacgtcggcgtgttcgtcggcacgatgtacaacgagtaccccttcttcggcgtcgagcgctcgctggccggggagagcgccgacaccgggtccgccgtcgcgggcatcgccaaccgggtctcgtacttcctggatctgcacggcccgagcctcgccgtggacaccatgtgctcgtcctcgctgaccgcgctgcacctggcggtggagagcctgcgccgcggcgagtgcgccgcggccgtggccggcggggtgaacctctcgctgcatccgcacaagttccgccagcagacccgcctgaagatgtcctccagcgaccaccgctgccgcagcttcggcgcgggcggcgacggcttcgtgcccgccgagggtgtcggggcggtgctgctcaagccgctgtccgccgccgaggccgacggcgaccgcatccacgccgtcatccggggcacggccgtcaaccacggcggcaagaccaacggttacatggtgcccaaccccgtggcccagggcgatctggtccgtgcggcgctgcgccgcgcgggcgccgacccggccaccatcggctacgtggaggcgcacggcaccggcacccagctcggtgaccccgtggagatcaacggcctgaaccgggccttcgcgggcgcctcggtggccccggcgagccgtgccatcggctcggtgaaggccaacatcgggcacgcggaggcggcggccggcatcgcgggcctcaccaaggtggtgctccagctccgccaccgccacctcgtgccgtcgctgcacaccgaggagctcaacgacgcggtggactgggcgagttcaccgttcgaggtggtccgcgaaggccgcccgtgggccccgctcaccggagcggacggcgccccgctgccgcgccgcgcgggcctcagcgccttcggcgccggaggagccaacgcgcatgtcgtggtggaggagtacgtccccggcacggcaccggaacccaccgaacccggcgtacccggcgtactcgaaccgcagttgatcgtcctgtccgcgcacgacctcggccggctgcgggcactggccggacggctgcgggaccggctcggacgcgacgaccggcccgcgccggccctcgccgacgtggcacacaccctgcagagcggccgggagcccctgcgcgagcgggtcgcgctcgtggcgtacgacgtggccgggctgtgccgcgccctcgacctgttcgcctcgggcgacaccggcgcctgggtgcacggccgcacccccggcggcgccctgcccgacggcccgaaggcggtgctcgatgctgccgccgaccgggacgcggagctgctgcgcctgggccggcactggacggggggcggcacggtcgactggccgggtctgcacccggtgcgccgccgcctggtctcgctgccctcgtacccgttcgccgaggaccggcactggctgcccgaaccgcggaccgcggctccggcggcagcggcagcaactctgacggaaccgtccgggaccacgctgtacggccgcacctggcgggctctgccgccgctcgccgccgcggccgctcccgcaccgtcgggccgtgtcctctgtgtcttctccgcacccggcgagcccgtggcgcgcgccctggccgcactgctcggccccgaccgggtcacgctcgtccgggcgggcgccgacgccgggaacggtgtccccgggatcaccggcatcggcgatgaggccgaggctgccgcgttcgcgcaggggctgcgggccgacgggccggatgccgtgggcggtctgatcgacctcaccgacctcggcggccccgcccacggggacgccggatcctggacggcccggctcgtcctgctgcggcggctcgtgcgcaccctgcgcggccacggcggccgcgtactgcacgtgaccgagggcctgtacgggcccgcgggccccgcaccctcgctcgccggtgcgcgcatggccggtttcgtgcggatgctcggcgcggagtacgggcgggtcaccggcaccgtgctcgatctggacgtctcggccgtcggacccgacgcggccgcgcgccagatcctcgccgagtacaccgggccgtacggcccgggcgacgtgtccgtgcgcggcggggtgcgccaccgccccgaactcgtggccctgcccgacgccgggcaccggtcgctgacccccgccgtggaccgcgcctacctcgtcaccggcggcacccggggcatcggggcccgggtggcccggctcctggtgcgccgcggcgcccggcggatcgccctgaccggggcccgtccgcagccgccgcgtgccgactggccgctcctttcgccgggcacacccgaggccgaaacggcgtcgctggtagccgagttggaggcccagggcgcgcgcgtcctggtgcactccggcccgctgagcgagcgggagcgcaccgaccggttcctgcgcgaggtgcgcgaggtgctcggcccgatcggcggtgtcgtgcactgcgcggggcgcgggcctgtcggcaggccctcgttcatcggcaaggaactcgccgacttcgaccccgtactcgaacccaagacgacgggcctcgaggtcctcgacgagctgtgcgccggtgaccggccggagttcttcgtgctgttctcctcgctgtcggccgtcgcacccggcctggccgccggcgtcctcgactacgcggcggccaacgccttcctcgactgttatgccgatcaccaggtgcgctcgggacgcccctggttccgttcggtcgcctggcccacctggagcgagtcgggcatgggcgcggaccggccggacagctgcgcgcccgtgggcgtgggaccgctcggcgacgaggaggggctgcgggtcctcgaacggatcctcgccctgccggccgagcaggcccgcatcgtgccctgccccccgatcgacggcatcgccgccgaccccgcggcactgctcggttccccgcgggacaccgacgcaacggcctccgtggggtccacgacgtcggccgggtccacacccatggccgggtccacacccatggccggttccacacccgcagccgggtccgcacccgttccgacgacgaccggggccacgccgccccggccccgtgaagaggagcacaccgtgccgaacacctcagtcaccgggccgccctggctcgccccgctgttcagcgagctcctcgcgattcccgaggacgccctggacccgacggcgctcctcggcgacctgggggtggaatccgtcctcctgggtgagatcctgctgcggctcgaggaactgacaggtctgtccctcgacccggcgacgcttctcgaccaccccaccctcgaactcctgggccggcatctggcggacctcggggtgccgagcgcaccgcccgcgcccgccgcgaccaccgcgcccgccgtggctcctgtgacccccgtgactcctacggctcccgtggctgtggcccctgtgacccccgtggccccgtccgggaagatcgccgtcatcgggctctcctgccgcttccccggtgccgaggacgccgccgccttcgcacgcaatctgctgggcggcacctgctcggtgaccgaggtgccgccctcgcgctgggacgtcggtgagctgtaccggcccgagctcgagccgggccgcagcaccagcaaatggggcggattcctggacgggatcgaggacttcgaccccgagtggttcggcatgagcgaggacgaggcccgctgcctcgacccggccgtacggctgttcctggaaggctccgccacctgtctgacggacgccggatacggtgcgcgggagctggcgggccgcgacgtgggggtgttcgcgggcgcccggatgtcccactacgggcgccgggtgggcgagcggcgcggtctcgtgggcatgggctccgaccagaacttcatcgccgcgcgcatcgcccaccacttcgacctgcacggccccaacctcgtggtggacagcgcctgttcgtcctcactggtggcgctccagctggcctgccgcagtctcctggacggcgagtcggagctggcgctggccggcggggtcgacgtactcctggacgaggagccgtatctcgacttcagcgcggccaaggcgctgtcccggcacggccgctgcgccaccttcgacgaggacgccgacgggttcgtgcccggtgagggctgcggcgtcgtcctgctcaagcccctggagaaggcgctgcgggacggcgaccggatccatgccgtgatcgacgcggtcgccgtcaacaacgacggccgcaccatgggactgaccacccccaacccggcggcacaggccaaggtcgtccgccgggccctcgccgcggccgggcggcgggccgacgaggtcggcctgatcgaggcccacggcaccggcacgatgatcggtgatccgatcgaactgcgtgccctgaccgaggtgttccgcgaggagaccggacggaccggcttctgcgccatcggaagcgtcaagaccaacgtcgggcatctgctgagcgccgcgggcatggccggcctgatcaaggcggtgctcgcggtacgggacgggcggatcgcgccgacgctgttctgcgaacggcccaacccgcgcttcgacttcgccgcctcgccgttctacccgagccgcacggcccacgactgggtgccggagcccggccgggtgcgggtcgccggggtgagcgccttcggcctgggcggcaccaacgcccatgccgtcgtcagccagttggatccagttctggcggcggcgcaccggccgcgcccggccctgcccgcgcccaacttcgcgcgccgcaggctgtggctggaggcggcgcctccgtcggcgcccggcccgcggccctcggtccccggtcgcccgccgctgggtgcctccatcctcggcctgaccttcgaggaacccctctccgaacccggttacgcccctctcaccccaaccccgaccggcgccgacaccgcagcggcgtcgcaggaaggacggaagtggtgaacgtgccctccgcaccgcagcccggacacgagttggtgtgccatctcgtcctggagcacagcgacttcatcatgcagaaccaccgggtgcacggggtgtccgtcatgccgggggtgaccttcctcgacatcgtcttccgcatcctgcgtgaccggggcttcgacacggcccgtgccgagctgcgcaacgtcctcttccacgaggcgatcgccaccagcgagggctgtgaccgcgacatccgcatcacggtgtcgacgtccaccgacggcagccgctggatcaccgcggagagccgccgccgcgagggcggcgagagcgccgcggactaccaggagaacttccgcggcgagctcgtcctgcacgacgtgcccgagcccgggccgctcgacgtcgaccggctgcgcaccaccgcgcggcgcgtggccgacctggacgagatgtacgcgcgggcccgcgccgaggagatccggcacggatccgcgatgcgctgcttcggccggctctactacggcgacggcgaactcctcgccgaactgggtctggacggggaggcggcggcgctcgacgagcacttccatctgcacccggcgaaaatggactgcgccaccatcgccgcgttcgcgcaggtgccgccgccggaccaggacccgttcatcccggtgttcatcgagtcgttccgggccccgcgcccgctgaccggcgtcgcgtacgcccatatgccgcgccccgagacgtacgcccagtccggggacatcatgcacaacgactgcgcgctgtacgacgccgacggccgcttcctcgccgggttcaccaagctgacctgcaagcgcatccgcaaccccgagctcatcacccggctcctcgacgccccggacgtgacgcgcacggccgcgcccgccccggctgcggtgtccccctcccccgttgtcgcgcctgcctcgtccgacggcggggccgggccggacgcggtgcgcgcgcatctgcgcgaactggtcggcacccttctcggcagggcgccccacgcgatccgcaccgatgccggtttctacgacctcggcctggactccgggcacatgctggacatcagccgccgcctggaggaatacgtctgcgcgccgctctatccgacgttgctgttcgagttctccgacatcgactcgctcgccgcgcacctgtacgccgagttcggcgcgcaggtgcgcagcgcccccgcgaacccgcctgccacacctgccacacccggtgaggacgccggagcccctcccgcgtcggcggccaggagtacggcccgcgccgtcgcgcccgccctcggctgccaccggccggtgtggacaccgctgcccgccgaccccggcgctttcgcggcggacggcgcacggaccgtggtgctcgtcggtgccgacgccgcgaccgcggccgccctgcgcgacgccgcggccccggcccgggtggtacgcgccgaacgggcctccgcgttccagcgcctggccgccgaccactaccggctcgacccggccgatccggaccagctcgcctcgctgaccgccgcgttggcaaccgacggcatatccgcgacggcgtacgtccgctgtgcccgcacccgggacacggacggcgccgggagcgcgctgccggatgcctacctcgagagctgggcgctggccgtggccgtcaccggtacccggccgacggggcctgtcccggtactgttcctgcacccgcgcgatcccgccgcgccccgcccgcacgaggacgcgctgggcgcgctcgcccgcaccgtcgccgccgaggcgccgcagctgcgctgccgtgcggtcggccacgacgccaccgcgacggccggcgatctcgccgccgtcatcgccgccgagagcacggacctgtccgcggagagcgaggtacggcacacgggaggcacccggctcacggtgcgccacgagacgctggccgtgccctccgggaacggcgcgggcgtgctgcgcgaggacggcgtgtacctcgtcaccggcgggggcggctctctcgccgcactgctggtggaccgcctggtgacgcgtggcccggtgcggctcgtgctgaccggccgcagcgcgccggggcccgagctcacacagcggatcgaaggctggcggcgacgcggcgccgaggtcacccacgtgcgcggcgacgtcgcccacaccgacgacgtgctggccgccgtgacctgtgcgcgcgagacgtacggccggatcgacggggtcttccactgcgcgggcagcgtcgacgacggaatgttcttccgcaaggacccggagcgctccgcggccgtcctggccgccaaggtggccggcacccggaatctcgacgaggccaccgcggacgacggccttgcgttcttcgcgctgttctcgtccgtttcggcgtccgtggccaacccgggccaggccgactacgcgtacggcaacgcgttcatggagcacttcgccgagcagcgtgccgcccgcgcggaccggcccggcgtctcggtcgcggtcggctggccgctgtgggccgacggcgggatgcgggtctccgaagacgtgctgcgccgctccgccgacacgtccgggctgcacgccctgcccgccgacgcgggcctggacgcgctgttcgggctgctctcgggggccgcgccgcgggccgtcgtcacgtacggcgaccaggagcgcatcgccgaactgctgcccgcgccccggccctcggccgcacagtccgggcgcaccggctcccccgactcgcctgactccccggacggcgacgacatcgcgatcatcggcgtcgcgggccgctaccccgaggccgaggacctcgaggcgttctggcgcaatctcgccgagggccgcgactgtgtcggcgaggtgcccgcggaccgctgggaccacgcggcgtactacgacccggagcggggcaaggagggccgcacatacgggcgtcggggcgggttcctcgacggcgtcgaccggttcgacgcggcctccttcggcatctcgcggcgcgaggccgagctgatggacccgcaggagcggctgttcctcaccgtcggccggcaggccgtcgagaacgccggctaccgcccggaagaactggcccgcacccgggtcggggtcttcgccggtgtcatgtggaaccactaccagttgtgtacggacggcagtgccgagcccgtcgcgccgaccgccctgcactgctccgtcgccaaccggctctcgtactgcctggatctgtccgggcccagcatggcggtggacaccgcctgctcgtcctcgctgacgtcactgcacctggccgtggagagcatccggcgcggtgagtgcgcactggcggtcgcgggcggcgtcaacgtcgccgcgcacccgcagaagtatctgcagctcgctcagggccggttcctgtcgtcggacgggcgctgtcgcgccttcggcgcggacggcgacggctacgtgcccggtgagggcgtgggcgcggtgctgctcaagccgctggccgacgcgctggccgacggggaccacgtccacgcggtgatcaagggctcgttcctcaaccactcggggcgcaccagcggtttcaccgtgccgagccccgcggcgcaggccacgctgatcgccgacgcgctggaccgctccggtgtcgccgcggacagcgtcggctacatcgaggcgcacggcaccggcaccgcgctcggcgacccgatcgagatcgaggggctgaggcaggcgttcgcggacgcggggctcgccccgggcagctgcgccatcggctcggtgaagtccgggatcgggcacctggagagcgcggccggtatcgccgccgtcaccaaggtgctgctccagatgcgccaccgggagctggtgccgtcgctgcacagcgaacagcccaacccgcacatcgacttcgcggccacccccttcgccgtgcagcggacccgggccccttgggtgccgcgaccgggcagcacggtgctgcgcgccggcgtgagcgcgttcggcgccggtggctccaacgcccatgtcctcctggagagcgcgccgcccgcgccggccacccctgtggcgggtccgcagctgttcgtgttctccgccaaggacgagcggacgctgcgcgaggtggtacgccgccagctgcgccacctggacggtccgggcccggtcgggagctcggcggacgaggcgacggcgctgctcaccggggaggtggccgcgctcctggacgtgcccgtggacgccgtggacgtgcgggagaacctggccgacctcggggtcgaccgcctggcgctcgccgagctcggccgccgcgtcgaggggcgcctgcccgccggggtgccgctgtccgggcaggcgtcggtcaccgaactggccgcgtccgcggcgctcgccgcccggccggacgcgctgccgctcgcggacatcgcgcacacgctgcgggtcgggcgttccccgctcgccgtcaggctcgccgtcgtctgcggtgaaccggaggagctgcgccggaggctggcggcgttcctggacggcgacgagcccggcgagggcgtgttcacgggccgcgccgacgacgacaaggagcccgtgcggcttgagcgggccgccgagctgttccgcctcggccggctgtccgagctcgcccgtgcctgggccgacggggccgcggtggagtgggacgactgccgcgccggcgacggcgtacggccacgtcgcgtaccgctgcccgcgcaccccctggacgagcgctcgtactggatcggcggctggcgcagcgcgcaggagaccggcgagagccgggagccggtcgagacggcgcatgctccaactgccgtgcctgcggctccggttgaccaggcggacctgccggaggtgcgggaggagcggcccggactcgacccgcaggaggtgctgtgggccgtggtggacgcggtccggacgcggctctatctcgagcgggacgaggtcgaccaccggctgtccttcaacgagatgggcgtggactcggtcggcgccgtggagatcgtcgagcagctcggcgcacgtttcgccctggagatggacccggtgacgctcttcgaccacccgacggtgccccggctcgccgagcacgtcagggaactgcaccggcagagtccggcgccgcggccacaggccgcaccggcccctgcacaaccggcggcacccgaggccgccgccctgcccgcacccgcacccgcacccgcaccggcaccggcaccggcaccggcatccaaacccgagccggccgcgtccccggacgcctgcgacgacatcgccgtcatcggcatgtcgggacgtttccccggggccgaggacctggacgccttctgggagaacatcgccgccgggcgtgacagcttcaccgaagtgcccgcgcagcgctgggacgtcggccccgtcttcgacgccgaccgtctcgtccccgacaggacctacagcaagtgggcggccatgctgcccgaggtgggccggttcgacgcggcgttcttcaaccactcgccgctcgaggccgaggtgatggacccccagcagcggctgttcctcgagcagtcctgggccgcactcgagcacgccgggtacgcggtgggcgccgacgaccgcacctcctgcggggtgttcgtcggctgtgcgcccggtgactactcgacactgctcaccgaggcgggccgggccgacaccggccacgccttcctcggcaccaccagttcgctgctgcccgcccggatcggctacttcctgaacctggacggacccaccatggccgtggacacggcctgttcgtcctcgctcgtggccgtgcacctggccgccgacagcatccggcgcggcgagtgcgccatggccctcgcgggcggtgtggccctcatggtcaccccgcagctgcacgtcagggccagcaaggtcggaatgctgtcgccgcgcggcacctgtgtgccgttcgacgcgtcggcggacggcaccgtgctcggcgagggcgtgggcgccgtcgtactgaagcgcctggaccgggccgtcgccgacggggaccacatccacggcgtcatcaaggcgaccggggtgaacggcgacggccgcaccaacggcatcaccgcgccgagcgccctctcgcaggccgcgctcatcgcggacgtgcaccgcagggccggggtgggcgccgacgacatcgggtacgtggaggcgcacggcaccggtaccgcgctcggcgacccgatcgaagtgcgggccctgaccgaggtgttccgccgctcgaccgatcgcagcggctactgcggcatcggcaccgtgaaggccaacatcgggcacaccaccatggccgcggggatcgcgggcctgctcaagacgctgctcgcactgcgccacagcgagctgccgcccgcgcccgccttcgacaccccgaacccgaagacggagctggactccagccccttcttcgtggtccgggaccgccaggagtgggagccgggtcccggcggtcagcggatcgccacggtcagcagcttcggcttcagcggcaccaacgcgcacgccgttctcgcgcaggcccccgagccgcaggcccgccccgaagagcccgaccaggagcggctgttcgcggtgtccgcccgcgacggcgcggccctcgaccggctgctgctgcggctcgccgacagtgacctggacggcgtcaccccggccgacctcgccttcacgctcggtgtcggccgcgcccatctgccggtgcgggccgccgtgatcgcccggaacgtgcccgaactgcgccgcaggctccgcctgctgcagtccggcgcccaggccccgggctgcttccgcaccggtcagggggccgcggccggcgacctggacgagcagacccgcgccgagctcgcgggccgcgcccggtcgggttcgcccgccgagcgtgtcgccgccctggagcgcctggccgccgcctatgccgcgggccaggacctcgactggcagtccctgtcgtacggggaccggccgcgccgggtgccgctgccgacgtaccccttcggcggggaccggcactggatcacactccccgacaccgaccgcaccgccgtgcccgccacggcacccgccacgtcccgcgtcgacctcccgggccagtcaccgcagtcgactccccaccccctgctcggtgctgtctccggggcgcccggcgacccggacggcgcccgcttccccgtgcccgtgccggccgcgcactgggtgctcgaccaccacaggatcggcgaccggccggtcctgcccggcgccgccgggctcgacctcgcggtggccgcggcccggcgctgcggcctgcgcggcaccgtgcggctgcacggcgtgcagtggctgcggctgatcgacgccgaggccgccggcacgctgcggctcaccctgacctcggacggcgaggggtaccgcttcgccctgtccaccggtgacgacgggaccgtctgctcccgtggctcgctcacggtgcgccccgatgcacaggacgccgccgccccggccgcgtcgtccgagaccctcgatgtcgcggagatcgccgcccgctgtccgtacgaggtccccgccgagcggttctacgacgacttccgttccggcgggatcgcctacggcccgtccttccgggtcctggagaagatcacctttggtgacgacgaggtgctcggcacgctgcgcgccaccccggacagcggcgggttcgccctgcaccccgccctgctcgacggtgcccagcagaccatcgccgccctggaagggggcaacgacgccaccctggtgccgttctccgtcgagacggtggaggtcgtcgacgcgacggccgtccccgcgttcgcccatgtcgtccgtgcgggaaagcaccgctacacggtgcgcctggccgaccggtccgggcgggtctgtgtccgctacgagggcctcgccctgcgggcgcagcacaacccggtcgactccatgatgtaccggccggtgtggcgccccgctcccctgccgcagcccggcaacgcgcccgcgggcggccgtacggtggtggtccacaccgccgactcgacgaccctggccgccgcgctcgcggcccgcacgggagccggcctggtggcgctgtccggcgcgcaggacgcggcgccggacccgtacgcggtactcgaacagcccctggaaaccgtctacttcgtggcccgcaccggcgacgccgaagggcccgccgaggcggaccgcaccgcccttgacctgttccgcctggtcaagcggatgctcgcggtgggccgtgcccgtgaccgcatcgccctgcgcatcgtgcttgcgggcgccgtaccggcggaccccgaggacatgaccgagaccgtgcgtccgcacgccgccggagtgctcggcctggcccgtgcgatcgagtcggagtgcccgcgctggagcgtcgcctgtgtcgatgtcggcgcggacggcggcaccgtcggtgccgagcgcgcggccgagcggatcgtggccgagccgggcaccgaaccgctggtgctgctgcgcggcgaggagcgcctggagcgcgtcttcgagccgctgcgccccgccgcgccccggggcacggagcccttccgcgagggcggcgtgtatgtgatcgtcggcggcgccggcggcatcggcttcgcgctcagccggctgctcgcccggatcgcccgggcccgcctcgtgtggatcggccgcagccccgagggcccggaacaccgggccaaggccgaggagatcgccgcgctgggcggccaggtcctctacgtgcaggcggatgtcgccgacgaggcggcactgcgccgggggctcgcctccgttcacacccggttcggtcaggtcgacggcgccgtgcacgcggcgctcgacctgcgggaccgcaccatcgccctcatggacgaggaggacttcctcgccgggctcgcgcccaaggtcgccggagtcaccgccttcgcccgcgtcttcggggccgagccgctggacttcatgctggtcttctcctccgcggtgtccttcgtggaggcgggcggtcaggccaactacgcggccgcgagcaccttcgaggacgcctacgtccagtggctcgaccggcggcacgactacccggtgtccgtcgtgaactggggcttctggggcagcgtcggcgcggtcgccgacgaccggatgcgggcggccttcgcccgtctcggcgtcggctccgtcgaacccgccgagggcatggcggtgctgcgccggatcatcgccgggcggctgccgcagaccctcgcgatgaaggcggaccgcgcggcgctgccggccatgggcatccgggtcgcgggtacgcccgagggcgaagggccggcccgtacgtcgccgcccgcgacgagcgccgcgcccggcccgggcaccacgaccccggccccgtccccggcccaggtcgcggtcccggacccggtggctgccggtgcggaggggctgtcggccgaggccgtgcggtcctacgtcgccggggtgttcgcggaggtcctcaagtacgagagcgcggcgctcgacccggaggccaccttcgagacgttcggcgtggactccctggtgagcctcaacatcgtcgaccgcttcgagcaggacctgggtgacctgccgcagaccctgctcttcgagtacatgacgatcgaccaggtcgccgggtacttccgccaggaacacggcgagcagctcacccgggtcatcgccccggcccccacgcaggaccagggccagggcgccgtggccgcgtcccccgcggccgaggtggtgtccggcgccgccgtccagggcggtgacgaggaagtgttcgcccgggcgcaggaggcgttcgccgcggtcgaggcgttcagccgcgatctgctgcgccgcaccttcccgcgcttggacggcgtgccccggcccggcgagcggatcacggccgacgaactcgcctcccggctcggcgtggtccgccggcaccgccgcctcttcgacgccgccctgagcatcctgcggtcctgcggagcggtgacgggcgacgcggacaccctcacgttcgccgagccgtcggcggcgccgggggcccgcgtggagggcgccgaagtcgccgcgctctacccggagatgagcggtcacgtcactcttctggaacgcactctcggcgccctgggagaggtcctcgcgggccgcaggaacccgatggacgtgctgttcccgaagggctccgtggccctggtcgagcccatctacaagggccagcccatcgccgaccactacaaccggctgctcgccgacgaggtggccgacgccgcccgccgcgtgcgcgcccaggaaggccgcccggtccgggtcctggagatcggggcgggtaccggagccagctcccgtaccgtgctggccgccctggccgccgcggacgccggggcccactactgctacaccgacatctccccggccttcctgcgccacggcgagcgggagttcggccccacctatccgcaactggccttccacaccctcgacatctcccgcgacccggtggagcagggcatcgaggccgcctcgtacgacgtgatactcggcacccatgtgctgcacgccacgccggacatggagcgcaccctgcgcaacatccgcaccctgctgcggccgggcggactggtcctcgtcaacgagatcacccgcttctccgagttcctcacgctcacgttcggtctgacgaccggctggtggatgtacgaggacgcacagtgcaggctgccgcactcaccgctgctcgccccggtccagtggcggcagagcgcggcggcggccgggctgcgcaccgtgcgcaccggcggtctgccgggcgtacccgccgacgagctggagcagtccctggtcgttgcggagcggcccgtcgaggactccggcgacgcgtcaccggacggtgccgcggacgagcagtcgcccgagtccgtgcggtcctatgtgaccggcgtgttcgccgaggtgctcaagtaccgtgccgaggacctggatccggcggtgaccctcgagaacttcggggtcgactcgctggtgagcctcaacatagtcgaccgcctcgagcaggacctgggcgatctgccgcagaccctgctcttcgagtacacgagcatcgacagcatcgcggagtacctgagcgccgagcacggggagcggctcgcccgggtcctgggcggggctccggcggcggcccaggcccagccctcggctcccgtccccgcccccgtttccgtcgatgtccccgcccccatccccgctcccatccccgcccccgtttccgtccccgtcgacgtccaggaacccgagtccgagcccgagcccgcagcggctgtgcggaccccggccggcgacgaccccgcggatcctctcgacatcgccgtcatcggcgtcgtgggccgctacccccagtcccccgacctggaggcgttctggcgcaatctctccgagggccgcagctgcatcaccgagatcccgtccgaacgctgggactggcgccgcaacttcgacccggacaagagccgcaagcaccgcagctacagccgctggggcggcttcctcgaggacatcgagatgttcgacgccccgctcttcggcatcctgccgcgcgacgcggccgacatcgacccgcaggagcggctgttcctcgagagctgctgggagctcctggagacggccggatacctcggcacgtacacgcacgaaccgcagaccggtgtcttcgccgggctgatgtacggcgagtacggcctcctcgcggcggccaccgactggcccgagggccgctacgccaccggccactccgcgtactggtcgatggccaaccgtgtctcttacacattcgacctgcagggcccgagcctcgccgtcgactccgcctgctcgtccgcgctcagcgccatccagctggcctgcgagagcctgcgccgcggtgagagccggatggcgatcgcgggcggtacgaacctgatcctgcacccggcccacttcgcggccctgtgcgcccgcaacatgctctccgccgccgacgcctgccgcgtcttcgacgacggcgccgacggattcgtccccggcgagggcgcgggcgcggtgctcctcaagccgctcgcgcaggccgaggccgacggcgacaccatctggggggtcgtcaagggcgcgttcagcaacgcgggcggcaaggtcagcggttacaccgtgcccaaccccaacgcccaggcccggctcgtggagcggacactgcgccgctccggcgtgcacccgcggacggtgtcgtacgtggaggcccacggcaccggcactgcgctcggcgaccccatcgaactgggcggtctgaccaaggcgttccgcgccgcgggcgccaccggcgacggctactgcgccgtcggatcggtgaagtccaacatcggccacctggagggcgcggccggtatcgccgccgtgacgaaggtgctgctccagctcaagcaccgcgctctggcgcccaccatccatctggaccgtctcaacccgaagatcgatttcgcgggttcgccgttcgggccgcagcgcaccgccgagccctgggaccgtccggtcgccggtgtggacggcgcggagcgcagctggccgaggcgggccggcatcagctcgttcggagcgggaggagcgaacgtacacatgatcctggaggagtacaccggccaggacccgcgggacgccgaggacaccatgggcgccgcgggtgccgaggagccggagctgttcgtgctctcggcgctcgaccgcgaaaccctcgcccggcacgcggggcgtgtcgccgacttcgtggccggtcccgaaggcgcgcgtgtccggctcgccgacctggcgcacacgagcagggtggggcggcgcgagctgcccgagcgcctcgcggtgacggccgcgtcgcatgcacaactcgccgccagactgcgggagttcgccgcgaccggggtggcgggcgagggcgtgagcaccggcacggcccgcaagggcggggccggcagcgggctcggtgcccaggaactcaccgccgccctggccgggcgccgctgggcggacgccgtggagcactggacgctcggaggccgggtcgactggcgtacggcggacgcgggacgcctggtccgcaaggtcgcgttcccgacgtatccgttcaaccgcagccgccactggatcacctccgacccgcaccatctggcgccggagcttgcgagcggcggccgtccggccgaggagccgctgtccggttcggagccggcggcccccgaaccggccgcgacccgcctcccctccccggagccggccggccccgaacccgtggccgcagaacgccccgtcgcggttcccctcccggtgcccgacctcgtgcagccggtcgaggacaacgatcgcgacgaaggcgggcccgcggccgacgtcacggccgagcgcggggccactcacccggcgctcgccctcgcggcgcatcaccggatctccggtgcccgctgggtacccggggtgtcgctcctggaagtggcccgcgaggcctgtcccggcgcggacggctccgcgggggccgaattccccttccggctcggctccgtgcgctggctgacgcccgtcgacctggacgccgggaccgaccgggtgacggtcggcttcaccgacgacggcaccgggaccgcgttccggatcaccgcgggcggcccgtccggcaccaccgtcgcccggggcaccctcaccgagggcccctgcgccgacgacgccggcatcgacctggccgccgtgcgggaccgcagcaccgggcgccccgacccctgcgagttctacgacgcgttcgcccgcgcgggcctggagtacggccgccccctgcgcaccgtcgcggagctgtggacgggcaccggtgagtgtctggcccggctgagcctgagccgcctgatgcgccgcgtcggccccgcccacgccctgcaccccgcgctcctcgacggcgcgctgcaggcggtgtcgagcctgtgcgcggcggacgagtcgtatctgcccgtcggcatgggggagatacgggcccatggcgcgctgcccgcggacagctgggcctacgtcagggaggtcacggccgagggcgggacgggtggccggcgccggttcgacatccggctcaccgacggcaccgggcgggtcctgcaggccgtggacggcctggagatcgccccgcgcgcaggaggcggcgcgcccgagacccgtacccgctacctggcaccggtgtggacgcccgcgcctctgcccgccggggagcaggcgccgggcaccgtgctcctgtgcggcgccgagacgccccaacgccaggaactcgccgggcagttgacggccgcgggcagcaccgtggtgtgcgcgtccgacggcccggccttcgcccgcagcgacgccggcccccacgccgcgtacaccctgcgcggcaccgacccggccgagcacacccggctgatcgaggacctcgcggggcgcgggctgctgccggatgccgtcgtacacctggccgacgaagcggaagccgacatccaccgacaggacgtcgacagcggtgagtcggtcctttcgttcgtcctgtggtccgcggtggccgtgctgggcaggcccgaacgccccggcctgcgcgtcgtgttcgcccaccgcgcgggtgcgcagggcgccgagcccctgcacatcgcggtcggcgccacgctgcgcaccctcggcctcgagcacagcaggttcagcggcgtacgcgtggagctgcccgcgggcggcgccggcaccgacgaggtcgtcgccgagctgcgcgccgcgcggccgggtgccgtcgaggtctcgtacgccgccgacggtggccgcagcgagaagaacctggagccgttcgagccgccggccgccggtctgtgcgacttcgcgccgcgggcgggcggcacctatctgatcaccggcggcgcgggcgcgctcggtctgcacttcgcggcctacctcgccgggcgggtcccggacgacgccacgatcgtgctggccggccgctcgcagccgggcggcgatgccgcccgccgcatcgccgagctgaacggcgacggggcccgggtgctgcaccggcccgccgacctgcgggacgcggcgtccgtggagcgcctggtggcgtccgtcagcgccgagttcgggccgctgcgcggtgtgctgcactccgcgggcgtgacccgggacgcccgggcggtgaagaagacggcgcgggagctcgacgaggtcctcgcgccgaaggtgtccgggaccgtgcacctggacgcggcgaccgcggaccagccgctggacttcttcgtcctgttctcctcgatgtccggcgagtcgggcaacctggggcaggccgactacgcgtacgcgaacgcgttcctcaacgccttcgccgcccgccgcgacggcatgcgcgcggccgggctgcggtccgggcgcagcctgtcgatcggctggccgctgtgggccgacggcgggatgacggtggacgacgccacccgcgagatgttcgcccgcacctgggacatggtgccgctgagcacccacgcgggtcttgaggccttcgtccggggactcgcctgcgaactgcccgccctgtgcgtggtggagtcgctggtacggcgtgaggcggcggccccggccacagcgccgcggcccgctgccgggcggcaggagctgcccgccatggacgtggtggcactgcgggagctcgtggagcacgaggcgcgggtgctggcctccgggttcctgctcgtggacccctcggaggtcgacgtggcggccgaactgctggagctgggcttcgactcgatcacactcaccgagctggtcaacaaggtcaacgaacgcttcggcctcgacctgctgcccacggtcctgttcgagtgccccgacctggtctcgttcgcggagtacctgacgcagcaccatgccgcggaactggcccagcactacgcgccggacagcccggccgagcgcacggaagtacgcgacgagccggccgtgtccgacggcacacccgccccggcccccgcgtcaccggtcgtccccgcgtctcctgcgccatcggtcccgaccgtgaccgcagtgaccacctcaccggcacccgcaccggcaccggcaccggccgcccgcgccgagatcgccgtcatcgggatcgccggggtgttccccggctcggcggacaccgacgagttctgggagcacctcgcgggcggcgtcgacctggtgcggccggtgccgaaggaccgcaccgcgatccgcgccaacccggccacccgcgagctgcgcggtggcttcctcgactccgtcgacaccttcgatgcccgcctcttcggcatctcgcccaacgaggccgccctgatggacccgcagcagcggctcttcctgcagaccgcgtggcgggtgttcgaggacgcgggctaccgtccggccgacctcgcgggcgccccgtgcggcctcttcgtcggggtcgccacccatgactacgacgacctgctcaaggagaacggcgtcgcggtacaggcgcacaccgccaccggtatcgcccactccgtcctcgccaaccgggtctcgtacctgttcgacctcaacggtcccagcgaggccgtcgacaccgcctgttccagctccctggtcgcgatccaccgcgccctgcgcgccatccaggacggcgagtgcgagctggccgtcgcgggtggcgtcaacgtcatcctgaccccgggcctgctggagtccttcacccagtcgggcatgctcagcccggacggccgctgcaagaccttcgacgccgacgccgacggctatgtccgcggtgagggcgtcggcgcggtcctcctgaagccgctggcccgggccgaggccgacggtgaccacatctacgcggtggtcaagggcaccgccgtcaaccacggcggccgcagcaactccctgaccgcgcccaaccccgagtcccaggccagggtcgtggccgccgccgtgcgcgaggccggggtggaaccggacaccatcacgtacatcgaggcgcacggcaccggtacccggctcggcgacccgatcgagatcgagggtctgaagaaggcgttcacgacgctgcacgaggagcgcggcgaggccgtgccggacaccgggcggatcgccatcggcgcggtgaagaccaacatcggtcacctggagacggcctccgggatcgcgggcgtcctcaaggtggtgcagagcatgcgccaccgcgtgctgcccgcgagcctgcatctgcgccggctcagcccgtatctgcggctcgacggcacgccgttcacggtcaacgaccgccaccgcccgtgggagcccgccctcacgccggacggcaggcaggtgctgcgggccggggtcagctcgttcggcttcggcggctccaacgcccatgtggtgctggaggcgtacccggcgcggaccgcgcccgccgtacaggacttcgccccccacaccgtgccgctgtccgccggcgacccggacgatctgcggggttacgcggcacggctcgcccggcacctggcccgcacgccggaggccgatctggcgcgggtcgcctacacgctgcagacgggccggaccgggcaccggcaccgcttcgccgtccgggtgcgggaccgtgacgagctgatcggcgccctggaggcattcgccgccggggagctgccggaccacgcggcgaccggaacggcccgccgtgacgctccctccgtgcagagcgacgaggaccccgcgctactgcggaagtcgtggtgcgagggcgccgacgtgccgtggcacacctggtggccgaagaccccgggacgtgtcccgctgcccacggcgccgttcgcccgcacacgccactggttccccaccccggatgccgaaccgacggcgcccgccgtacccgcacgcaaggaggccaccatgacagcccgcagtgaggcgcaaccgacgcgccgcggtcccaagatccgcctcgcggcgccgaggagcgcggggggtgcctcggcgactgcgccgactcgggaacccgttcccgcgccgccggctccggctccggctcccgccacgacggcaccgcagccggtccgggccgacgtaccgcccccggccctccccgaggcggcggccgcctccaccgtcgtcggcctgctgcgcggtgaactgtccaagatcctgggcatgccgtccgaggagatcgagaacgacgcccccttcggcgagctgggcctcgactccatctaccgcatggacctcgtccgcacgctcaacgaggccttcggcctggacctgaaggccaccgagctctacaactacgacaccatcggcaagctcaccgagttcgtcgcgccgctggtcggccccgccggggccgctcccgccgccgagccggtcatggccgaggcaccgcagcagtcctccgcgtcgctggaggacctggtacaggacgtcatcgagcgtgagctcggccgcaccgccgacccggccaagtccttcgtcgacaacggcttcggctccttcgacatgctgcgggtcgtcgcctccctggagcgggtcttcggcgccctgcgcaagacgctgctcttcgaccaccccacgatcggcgcactggccgcgcatctcgccgagacccacggcccggaggccgccagtcgtctgtcgtccccgccgcaggaccggccccggcccgggcccgccgcgtcccaggagccgtacaccggcggggcgctagtggtcgagaagaaggccctcgcgggtcagccggagctcgcctcggcggtggccggtctggagagcgcgtacggccgggagggcggactgccgggccgcgacatcgccccgctgatcttcctgggcgcgggccgcacggcgtacttcaacttctcggtccgggacgacgccatgctcacctggagctacgtcggcccgaccgaggagatgcccgccctggccacggagttcgtgcgctacgggcaggcgcacggcctggccgcgaacatcgtctcgctgatccgcctggaggaggtggacggcgtccggttcaccgccacccccttcggggcgctccaacgactcgaggggatcaaggacttcagcctcgagggcggccggatgcagcggcttcgctacgcggtccgcaagttcgagaaggccggcacgtgccggaccgaggagtacgccgtcggctccgacccgcgtaccgaccaggagatcaccacgctgatcgaccggtggtcggcggccaaggagatggtgaacccgtacgtctcgactgtccgggacgagatcggccgcggcattctcgccgcacggcaccggatgttcctcacctatctggacgaccggatggtcagcgccgtcatcgtcaccaagattccctccgaggacggctatctgctcgacctcgagttctatcccgaggacgcgccgctcggcagcctcgaccacaccgtcgtgaagatcatcgagcggacggcggcggagggctgcaccgtcttcagcttcggcggcagcttcggcgccaaggtctgcgagtcgcccaacgccgcgccggaggccgaggccgccctcacggagctgcgctcgcgcggcatcttcaccggtgacggcaacctgcgtttcaagaacaagttccgtacggagaatctgccgctgtatctgtgccagcccgcggacgcggagcgcaccgatgtctcccggctgatcctgatgatcgccaacccggaggtgggcggcgaccgcgcgcccacggccccgaccgccctggcagccccggctccgcgcgaggcccctgcagcaccggctccgcggcaggcccccgctcccgggcaggccccggccgcccggccgaagcccgccgccgctcccccggcggccgtcgcggcccaggcaaccgaggtgcccgccgatgcccgtcgccgtgagcggcagctggcggaccacggctggaacgcgctccatctggcctccggcgacgtcgagttcgacctgatcaccgactcctgggccgaactcgaccgccccttcgtgcacgcccggacggcgcggctgcacgccggggccgccgggcgtcccgtgggccagacgctcgaagggctcgatctgctgccgttctcgtgtgtcgtggccaccacgtccgggcgggccgcggaagcggcgctgtgccgggcctggccgcagcagggcgtcgtggtgcacaactcgctgttcccgacctggtacttcaaccacctcgaccacgggttcacgcccgtcgcggcccgtcgcgcggccggcgcggacgacggtgtcttccgcggcgacctcgacctcggccacctgaacgggctgctcaccgaacacgcgggccggatcgccttcctgtgcgtggaggtcagcaacaacgcgcagggcggggccgcgctcagcctgcacaacctcaccggcatccgggagaccgccgaccggcacggcctgcagctcgtcctggacgccacccgtgtcctggacaacgccgcgctgatcgccgcgcacgagccgggacagacgggccgcgatccgctcgacgtggcgcgcgagctgctctccctcgccgacagcgtcaccatcagcctctccaaggacttcggcgtggacaccggcgggatcgtcgccaccgacgacccgaccgtcgcccaccaccttcgggagcggatcgcgctgcgcggcccggaggcgggccgtgccacccgcgcgctcgcggccgccgcgctcgacgacctcggctgggccgcgacggcgaccggcgaacgggtacgccgcgtggcggacctgcggcaggccctcgccgcggccggcgccccggtcgccccgggcaccggcacgcactgcgtgctcctcgacacggcgcgcctgcccgcgctgcgcggccatgagcacccggtgcccgccttcctcgcctggctgtatctgcacaccggcatccgtgccgccgcccacctggacgacggtcccggcacctcgtccctggtgcgcctcgcgctgccggtcgggctcgggcagcgggagaccgccgagctcaccgcccggctcacggcgctgttcggcgccccgcagcagatcccggagctgctgctcgccgcctccgacgggcccgccgccctcgcgtcgtaccacccggtggagcaggtgcccgacgacatccgggaggcgatggccgagggccacaccgccgagaacgacaactgggcggtgctgcgcgagcaccacccgggtgtcgagcgggtgctgctgcggctgcccgcgggcgacggcggcggcgacgtcgaggtgttcacggcgggcgcgggcccggcgctgctcatgatgcttcccttcaacatcggcgccgggctgttcggcccccagttcgcggcgctcagcgagcgctaccgggtgatcgtggtgcaccacccgggggtgggtgacaccaccgcgtgcgaggagctcggttacgagggcatcgcggatctgtgcctgcgggcactgcgcaggctcggcgtccagggtcccgtgcacgtggcgggcgcgtccttcggcgggatcaccgcccagacgttcgccctgcgccacccggagtccaccgcgtcactgaccctgatcggcagctcgtacaagctcggcaaccgggccggagaggtcaaccggctcgccctggtggccaaggaggacttcgaccaggtccagtcactcagcggttcgtcgcggctggaccgtgaacgcgcccgcttcgagcggctgctgctgcgctgcgaaagcatggacccgcagaccggcctgcgctacctcgacgtgttcgccaccgcgcccgacctgctcggccggctcggcgacatcgccgtgcccacgctgatcgtgcagggccggcacgacacggtcattccgcagaagacggcgcacctgctgcacggtgccattcccgacgcccgctaccacgaggtgcccgacgccgggcacttcccgagcctgtcgagctcggaggagttcaacgccgtcctgtccgccttcctcgaggagcacccggcatgaccatcacctcgtcgctcgacgtcaggcccgagatcaaacaggccgtcacggtgcggcccggcatgtgcggccccggctcgctgttcgtcggccagctcggcgactggacctgggagaccgtcagcgcacagtgcgacaccgatgtgttcgcggcccgtgacgcctcgggcaaccccacctatctggcgttctactacttccgggtgcgcggcggacgggagctgcaccccggctccctcaccttcggtgaccgcctcaccgtgacctcgggctgctacgaccagggcaccgagtcggtgctcacgctgcaccgcatcgacagggcgggcagcgatgacgcccaacgccccctggatctgcatgagttctacgagcggccgcgggacgggtccctgtacgtggagaacttcaaccgctgggtgacccgctccgcgccgggcagcaacgaggacctggtgaagtcctcgccgcccgggttccgcaatgacgggctgccgcagctgccggccgcgtactcgccgcgtgccgtgtaccgcgaggcacgcaccgcgcacaccttccgcgccctggacgagcccggtttccgcctgctgcccgacaccgtcgaggtcgagcacccggtggacatcgtccgtgacgtcaatggcgtcggactcctctacttcgcctcgtacttctccatggtcgacaaggccgcgctcgccctgtggcgccggctcggccgctccgaccgggcgttcctgcgccgggtcgtggtcgaccagcagatgtgctacctcggcaacgccgacctggactcggtcctgaccctcggcgcccgcgtccgggtcagcaccgagacgcccggcgaggaactcgtcgacgtcgtcatcagcgaccgcgacagcggccgcgtcatcgccgtcagcacgctgcacacccagcacgacgctcacgacccgaagggggaagcatgacccaggcaccactggatgtgcgggcacagacggcccggctcgtcgtcgaggtcgtcaccgagatcctgcccggtgtggaccctcaactcatcggcggcaagcggcatttgaaggacctgggggccgactccgtggaccgggtcgagatcatcgcggccctcctggaccgcacccgggtggacgcccccatgtccgacttcagcgacctgcccgacatcgacagcctcatcgactttctgagcggagccccgcgatgaccgcgaccggtgccgaacaggcctatggcatcgaggccttgaacgtgtggtgcggtctggcccgcctcaccgccgcggacctcttcgcgggccgcggcctcgaccccgagcgcctcgacaacctcatgatgtccgagcgctccatcggcctgcccatcgaggaccccgtcaccaacgccgtgaacgccgcccgccccctcatcgaggccctgtcgcccgaggagcgcgcccggatcgagctggtggtgacgtccaccgagtcgggggtcgactacagcaagtccctcacgtcgtacgtccacaagtacctgggcctgaaccggcactgccgcctcatcgaggtcaagcaggcctgtttcggcgcgaccgcggccgtgcagaccgcggtcggctatctggcctccgggatctcgcccggggcgaaggccctggtcatcgccacggatgtggcggtggtggacgagaaggccgagtactccgagcccgcggcagggcacggcgccgcggccatgctcctgagtgaccggccccgcgtcctcgccatggacctcggcgcgttcggcaactacagctacgagaccctcgactcggcccggccgtccccgcgcttcgacatcgccgatgtcgaccgctcgctcttcgcgtatctcgactgcctgaagaacgcgtacgcggactacgccgcacgcgtgaccgatgtggacttcacccgcgacttcgaccatctcgtcatgcacaccccgttcgcgggcctggtgaaggccgggcaccgcaagatgatgcgcgagcagggcgtcaccgggccgcggatcgacgaggatttcgcccgccgcgtcgccccgtccctgatctacccgggctcggtcggcaacctgtgctccgggtcggtgtatctggccctggccagcctgctcgactccggtgtggtgaccgcgccgagccgggtgggcctgttctcgtacggctccggctgctcgtcggagttcttcagcggaatcgtcgacgagcagtccgccgcgaccgtcgccgaacagggcatcggcaagcgtctcgaagcccgggcccggatcaccttcgacgagtacctggcggtcctcgaacacaacctcgagtgcctggtgccggtcgagaaccgcaccgtggacccggccgaatgggagccgctgctcgaccgggtcggcgaccgcccggagatcctcaccttcaccggcgtcaaggactaccaccgccagtacgcgtggcgctgaccccggcgcggccgtccggccgcggcccgcgaccacagcagcgacaaggagacgatgtgtacggctctcggacggccacccggcccgccggcgaggacggggctgcggccggcctgcgcctgttctgcttcgcccacgcgggcggcggaagctccttcttccacccgtggcggcgggccctggggcccggcgtcgacgtgcgccccgtcgtcctgcccggccgtgagcgccgggcgcgggagacctcgcacacccggatgggccccctggtcgaaggcctcgtcaccgaactggcccctcaactcgacctgccgtacgtcctgttcgggcacagcctcggctcgatcgtcgcctacgagaccgctcgggccctgctcgagcggggctcacgcccgcctctggcgctgctcgtgtccgggcggcgcgggcccttcgtgccggaccacaggcgcccggtgcacaacctgccggaggacgagttcctcgccgaggtgtcccggctcggcggcaccccgtccgaggtgctgcgtcagcgggacctgctgcggcacttcctgccgccgctgcgcgccgaccacgaggtcaacgagacctaccggccggtgccgccgccgggaccggccctgacctgcccggtgttcgcgttcaccggcgacgccgaccctctcgccgacccccacgcggtggcccgatggcgcgaggtgaccagcggcgacttccggctgcgggtctttcccggcgaccacttctacctgaagggggcgccggacgacctgatgtccgcgctccgggcggccatgggctccgtacatcagggctcaagtgttcttcgaaggcaggttcataaagttgccacgtgattgtcatgtgccgactgactgaccgggaggccagatgaacctgctggatgtcaccgaacccaccggattcgatgcccggctgcgtgacttcctgcgcgaccagtcgccccacaccacgacgacgatggtcagacggaaccagagtgcctacagctgcggcggtcaggaccgcaacgtgtacttcctggagagcggccggctcaagacggtgatgttctcccgctcgggcaaggagtgcctcctgcgcatccacacccccgggagcatcttcggtgagctgtgttcgctcggcgggatccgcgaggagtcggccatcgcgatgcgcgacagcgtcgtccaccgcatgtcgtacgagcacttcctgtcctcgatcaccgaggccgggatcgtcgacgagttcatcaaccacctcacccggcgcctcgccgaacagcagcagtccatcacgcatctggtgaccgtcgacagcgagcagcggctcggcgagatcctcctcgacctcgcccgcaagctcggacggggcgacgggcggcggccgcacatcgcggagcggatcacccacgaggagctggccggcatggtcggcaccacccgctcgcgcgtcgggcacttcctcaagggcttccgcgaccggggtctggtcgaggtcacccgcgagtcccacctgatcatcgaccagagccggctcgccgcctatctggagagccgatgcgtctgatcccgccgcaacgccccgacgaccctcacgaggtgacacccccatgtgggaccacaagttcgagactctgctcagggaccggctgcccggtctcgacgccgacgccccgctcaccgaggatctgccgctcgcggccttcgggctcgactcgatggcgacggtcggcctgatcgtggccatcgaggaggactacggcacgcccctgcccgacgacgccgtgacgcccgccaacttcatcacgccgggcacggtctgggagctggtcagctccctcgacggagccggccgatgagcggcgccaagctgctgcaccactggttcctcgacggtctggcccgcaatccgcggggcaccgcgctccgcatcaacgaccgcagctggacctatgccgaggcggaccgcaccgcgcgctcctgggccgcggccctgcacagcggggggcgcgctccgcgccgggtcggggtcctcgcggcgaagagcgaggagagcctgctcggctttctggccgcgctgtacgcgggctgcacggccgtcccgctcaacccggagtaccccgtcggccgcaaccgcgacatcgccgctgccgccgggctcgacgcgctgatcgtcgacccctcgggcgccgcccagctcgacgaggtggccgcggccgcgccgccgcttgtcacgctggcaccgcggctcggcgagtggagcggaccgcggccgggcacccccgtcctgatgcccgacccggcaggggaccggccccccgctcagggccccgactcactggcgtacatcctgttcacctcgggctccaccggccgccccaagggcgtgccgatccggcacggcaatgtgtccgccttcctggccgcctccctgccgcgctacgacttcggacccgacgacgtcttcgggcaggtctacgagctcaccttcgacctgtccatgttcgaggtgtggtgcgcctggtcgagcggagcgtgtctgaccgtcctcaaccggcttcaggccctcaacccgggccgctacatccgtgctcacggcatcaccgtgtggacctcgacgcccagcctggtcgccgcgctgcgcactcgcggcctgctcggcgggaacagcctgccttccgtgcgccacaccgtcttctgcggcgagccgctgcccgaggagagcgccgcgtactggagcgcggcggcacccggcacgtccatcgacaacctctacggccccaccgagctgaccatcgcctgcaccgcgtaccactgggtcccctcccccggttcgggcaccgtgcccatcggagagccgaacaccggcctccggtacgtccttctcgacgacggtcaggtcggcgccgacaccggcgaactgtgcgtcaccgggccgcagatgttcgacggctacctcgaccccgcgaacgacacggaccgcttcctgacccacgacggtcagcgctggtaccggaccggggaccgggtgcgccgcacgcccgacggcactttggtgcacctcggccgcgacgacggacaggtcaagatccacggctatcgggtggagctgtccgaagtggaggaggccgtgcgggcctgcgcgccgggcaccgaggcagtggtcctcgcggtcccgggagcggccggacccgtccttgccgccttcgtcatcggcgacgacgcggccggccggctgaccgggacggcccaggacctggcccaccggctgccgccgtacatgctgcccgcccatctgtgggcgctggcggacccgcccctgaaccccaacggcaagacggaccgcctgcggctgcgggaagaggcggcacgccgcctgggcaggaacctcgccccggcgtcctgaaccggctgacggcacacggcagttgacggtggagcaggcccggatcagatccgggtcagaccccgtcgactgccgtttcgcgtggccgggactcgtccgccgccggtgtgcgctccgcccggccggccagttctcctcgcacggaggggaccgcgtccagcacggcccgggtccacgggtgccgcggggcggcgaacacctcggcgaccgggccctgttcgcgtacggtgcccccgtcgaggacgaggacccggtcggccatccgcgcgatcacgcccaggtcgtggctgatcagcagcagcccgaggcccagacgggagcggagcccgtcgagcagggcgaggatctcggcctggatgcggacgtcgagactcgaggtgacctcgtcgcacagcaggagccgcggctgagcggcgagcgcccgcgcgatggccacccgctggcgctggccgcccgacagtgtgcgcggcagccggccggcccactgcgggtcgagccccaccaggcgcagcagccgctccgtctccgcggccgcggcctccccgccgagcccacgcagcacacgcagcggcctggcaatggccgcacccaccgtgcgccgcgggttgagcgatccgttcgcgtcctgcgcgacgagctgtacgaggcgacgctggtcgagggtgcggccgcgcagcggcccggggacagcggaaccggccagttcgatcaggccgccgtcggggctgtggtgccccgtgacgcagcgcgccagggtcgtcttgccggtgccggacccgccgagcagcgccacgcactcgcccggctcgatgcggaaggacacgtcctgggcggtcgtcacccgtgctctgccgcgcccgtgtccggcgcgcagcccgctgacccgcagcacgggcgcggtgtccgcggcgccgccggccggggcggccgggcgggccgccgcctcgccgatgtccggtaccgcgtgcaccagttcgcgggtgtacgccgcacggggccgcccgagcacggcgtccaccggtccctcctccacgaccctgcccgccttcagcaccgcgagccggtcggtcaggcgggcggccgcgggcaggtcgtgcgtgatgaacagcagcgtcaggttccgctcggcggccaggcgggccacctcgtcgaggaccaggcgctgggtgagcacgtcgagccccgtcgtcggctcgtccaggacgagggcggcgggtccggccgcgagcacccggccgagggcaaggcgctgctgctgtccgccggacagttcgtgcgggaaacgacgcaggaagtcccggccgtcgggcaggcccacgctgcgcagggtgcgggccgcgtcctcgggggtgcggcgcacggcgagttccgagaccagtgcgccgacccgcatcgtgggggtcagcgcggcggccgggtcctgcggcagatacgccacggtgtgccgccgcagccggcgcaggtcgcggccgcgcagggcgagcgggtcctctccggccacgcgcaccccgccgcccgcggtgcgcagtccgggccgcagggcgccgagcagggcgagcgcgagggtggtcttgcccgagcccgactcgcccacgacgccgacgcgttcgcccgcccgcacggtcaggttcagcccgtcgagcacgggccgtccgttcgggtcggccacggtcaggtcggtgacggagatgacctccggcgcggcgtcggcccgaccctgaccgtgcgggcgggcgggggctgggacggccaggtcgctccgggcgtcgaagactgcgctcaaggcacgaacctcgcgatcgcccggtccagggcaaggttgacggagacggtgaggacggcgagccccagtgcgggggccgccacgccccagggcgccagcgtcacgccctccatgttctcgctgatcatggcgccccagttggggctgtcgggtccgaagccgaggaagccggcggacgcggtgagggtgatggcgatggcgaggcgggtgccggcgtccgcgaggacgggccgcacgatgttgggcacgatctcccgggccatcaccgccaccggaccgtccccgagtgcgacggcctggtcgacgtatccggcgtgcacgacctgtgccgtcgcggcccgggcgaccctggagacgaagggcacgccggtgacggcgaccgccgtgacgagggtgagcgtgcggtagccccagccgtgcatcagcaccaggaggaccaggaccggcggcagggcgagcagcagggtgtcgaggcgggagaccaccgcgtcgacgcggccgcccgcatagccggcgagtactccgctcgcggtgccgaggagggtggtgacggcggtggcgagcagcgggatcaggaccagcgggcggcctccggccaggaaccgggaccacacgtcgcggccgtcgccgtccgagccgagcagcaggtggccggtgtcgtagggcgcggcggtgatgcgggccgggtcgtgcggggcgagccagggtccgatcagggcgaacaggacgacggccgccacgggcagcagcaacagcagcgcggcccgtcggcccggtcggggtgcggcggggccggtgtcgggagcctgggtgccggccggcgtcaaagcctcggtcgcagtcggcgtcggggccgtcatgtcgccgtcctcatgcgcgggtccaccgccatggccagcaggtcggccaggaggaggccgccgacgaccgccgcggccatgaggagcccgatgccttccaggacggccgcgtcgtgatgctgcacggcggcgaccaactctcttgacagacctgggtagttgaacactttttccaccacggccgtgccgccgacgagggtcccggcgagccagccgaagacctgggcgcacggcccggccgcggtcggcagcaggtgccgcagcaccacgcgggccggggacagcccggcgaggcgggccgcctccacgtgcggggccgccgccgcgtcgacgacggcggcccggaccatgcggctggcccaggacgcggagaacagcgtcagcgccgccaccgggagcaccagcgcctcggggtgtgcgagcaggggttcgccgaacgggaccagggacacggccgggagcactccgagccaggaggagaagaccagggtcaggatgcccgccgtgacgaactggggcaccgagaccagggtgacggcgccgccggagagcagccggtcgagcaggccgcccgggcgcagcccggcggcgattccgaccgcgagcgcgaggacgaccgtgagcagggcgcacacaccggcgaggagcagggtgtcggccagcgggcccgagatgatctcggcgacagggcggcggtccacgaggctgtgcccgaggtcgccggagaacgccgcgccgatccagtcgccgtagcgcaccagcacgggccggtcgaggccgagttcggcgtgcatcctggcgacgtccgcgggggtcgcggagccgccgagcgcggcggcggccgcgtcgcccggcagcacctcggcggcggcgaacagcacgaacgagccgaccagcagcgtggccagggcgccgccgagccggcgtacggccagggccgcgagccggacggcggacgtcacgcggacctggcccgggtgaacaccgggatggactggctcgaccacacccccgagagcccgggcgccgaggcgtccaactgctcctggaagccccacaggaggtcgccgccggaggagtacaggcctcgctggacggcggcgaaggcggcttcgcgcttgctgtcgtcgaccgtggcctgggcgctcgccaggcgcttgaagtgcggctcgccgagcccggtcacgttgaagaacgcgcccttggtggtcgtggcggacaggtgcacggcggcgggccggttggcgtagtagaaggtctggaacggggtgcgggcgaggcccttcaggtcggcgtagtaggtgtcggcgggcaccttctgcacgtcgagctccacgccggcctccttcagctgctggccgagcaggcgggccgcggccacgaaaccgggcacggtgtccgccgcgtgcagcgtcagcgagtggaccttggcgcgggcgaacagccgcctggcctcggccacgtcgcgcttgcggtccccgcccgcgtagccgggcaggcccttgccgacgacgtcgtcgcccttggtgccgaggccgaggagcacctgccgtacgagtgcctcgcggtccgcggcgaggcgcaccgcgcgccgcacatcggggttgtcgaacggggcgagctgctcgttcatggcgaaggacagcgcgttggagttggcggtgccgccccggcggacccggatcgcgctgttgccgcgctcggccttggcgcccgtggcggtgatgccgaaggcgtagtcgatctggccgctcttgagggcggcgaggcgggcggcggggtcggcgatgaggtcgagttcgatccgccggaagtacgaggtgccgccccagtacttgtcgttgacggcgaggcggaggttcttgccgtcgtgctcttcgagacggtacgggccggagccgacgcccttgtcgaagtccttgccgcgggtgccttcggggaacaccggtgagaagaccgcgaggacggcctccctgaagtcgccgcggggccgcttgagccccaccttcagggtgtgggcgtcgaccgccttgagccggtccaggtccaggtcgacgaagttgttggcgcgggtggacggcggcgtggcgagggtgcgcagcgagtaggcgacatccgcggcccgcaccggtgagccgtcgtggaacaccgcgtgcttgtggaggcggacgatccactcactggcgtccttgttgggctccaccgactcggcgagccccagctcgtagcggctgcccttgaggtacatcagctggtcgtacaggtggtacagggcgatgtagctggcaccgaacccggcgtgccgcgggtcgaggctggtggtgccggtggcgtccgacgccccgacccgcagcagcttgcccgcggagccgaccgaccgggtgtcgccgctcttggaggtggcgcagccggacagggccgtggcgcccgcggtggcagtcgccgcggccgcgccccactgcaggaagcggcgtcggccgacgccgttgacccgtgacatggcagaaagctcctcaggctcatgaaggtgtgcgggagacgtacgtggggggcgggttcaggacctgccggtcaggcccaccagtcgcgtgtgccgccctcgtcggcgccgcattggcgccagatcttgccctcgcgcaggacgtagacgccgaaggtgacgaccgtctcgccgcggacgatcatggtgccgcgcatcatgacggtgtcgtcggtctggatgaactcgttcatgtccacgtgctggaggtcgagctcccagtaccgcttgagcagctcgcggatgtcctcgcgcccgcgcacggggccggtgaaccggatccactcggcctcggggtggtacaggtcgacgagcccgtcgaggtcccgctcggccgtgcagcggatcatctcggcgaacagcgggtggatggggatctccgtgtcggtgctcatgacggggctcctgtcgcgtcgagttctgcggatgcggtgggtgcgggtgtcacgcctgcggccgatgccgtcagccggtcccggatgagacgtttgacgaccttgccgaggtcgttgcggggcaactcgtcgaccaccaggaccctttcggggatctcgtggggggcgaggctgtccttcgcgtgagcggcgagggtggccgccagcagcttcgggtcatgggtggcgccggccgcgggcacgatcgcggcggccacgccggccggcccggcggcgaccacggccgcgtcggcgaccgcctcgtgctcgagcaggaccgactcgacccgcagggacgacacgagcccggccggtgtgggcacggcgtcggtctcgcggtcgaagagatacagctcgccctcgtcgtcgacgtggccgaggtcgccggtgtcgcaccatccgccctccgggacaccggtggcctccgggcccgcgtcgaggcggttgcggggaggcgcgccgtcggcgcgcagccagatccggccgacccgatgggcgggcagctccgcgccgtgctcgtcggtgatcagtacatgggtgccgggggcgggccggccggccgacatcgggcgcgccgggtcgaaggtgccgatggtcacggcgggcttggcctggctggccgagtaggcgccgatcacgcgggcccggggcatcgcggccaacagggcgcgggcgagcgggggatggaggaacgccgaggcggtggccacggtggtgacggacgtcaggtcgtagcggccgagcgcgccgtcgcgggtcatctgcacggcgaggttcggggtcatcatgacggtgctcgccgcatggtgctcgatgagcgcgcacagccggtcggcgtctcccggcggcgcgaggacgagcgtggtcggggtggcgttgagcaccatggagacggtggtggcgctcgcggtgatgcccaggttcacggacgccaccatgggggtgggctcgtcgtgcgccatcacggagggcggtccgcccgccgtcgcgaggttctggtgcgagacgacgacgccgcgggccagtccggtggtgccggaggagtacacgatctcggcggcgtccgcggggctgtggacgaggtccaccggtgtctcgcccggggcggacagctcgtcgagcgtcccggtccaggcgacggccgaggtcgtgggcggggcggtccgcccgtggacgatgccggccagctcgcactgcagggcacgccgttcgagctcgtcggccgggagggcgagcggcaggtgaaggacggtggcgccggccttgagcgcgccgaggtaggcgaccgcgtagccggcccagtccatgccaccgaagaagatgccgatacgggtgccccggcttgtgccggccgcgagcagcccgcgggccagtgcctccgagcgccggtcccactcgccgtacagcaggtcggggcagccgtcgatgacgagtgcggtgcggtccgggtggagtgcggcgtgggagcggagctggtcggtgaggtaggagaacgtccgttccgtcatggcgtgctcaacccactatctggaacgcgacaccgtcgcggcccccgaaccgcggcgcggtggcggcgagcaggtggccgaggatgaaccgggcgcgctcctgcggcgggtcgtcgctcagggatccgaggtagcggtcgtgggccgcgagggagcgtacggcccggtcgcgggagtcgtcgtcgacggccacggcgtgcgtggcgtgcggggagccggcgatcgccaccttgccggcccgccacggctcgagtccctcgtcgagcagctcggggaagatccagcggttggcggcgtcggcgacggcgtccagggcggcgagacccacggcacggtggtcgggggtgttccacgcgccggacgcccaggtgtcgtggtggttgaaggtgacgatgagttcggggcggtgccgccggacggcgcgcgccaggtcgcggcgcaggccgggcccgtactcgatcgtcccgtcgttgtagtggtcgaggaagtcgacctcgtgcacgccgagttccgcggcggccttgcgctgctcggcctcgcgcacgggcccgcactgcgccggttccagatcggagatgcctgcctcgccccgggtgacgaggaggtacgccacctcgcgcccctgggcggtccactgggccacggcgggcccggcaccgaactcgatgtcgtcggggtgggcgacgatcgcgagcacgcggctgaagtcgtccggcagttcgaggagtgtgtcggccatggggtgtccttcccggtggacgaaggagatgaggtcaggcggcggcgtcggtctgcttgggaacccggatgaccagggcggcgatgaggatcgcggccgcggccaggcccgcgctgcacaggaacgcgacggtgtagccgtgcgtgccgccgaggccgccgacggcctgcgtgaccgtggtcagcaccgcgaggcccagggaaccgccgaccaggatcgcggtgttgaagagccctgaaacggctccggcgtccgcggggtcgacacccgtggtggccagcgtgcccgccggcatcatggtcaggcctaggccgatccccgagatgatcgtcgggccgaggacggtgccgacgaagctgcccgacgacgcggcgaggcccagccaccccatgccgagcccgagacagagcaggccggtcatcagcatccgggtcagcccgacgcgggcgaccgtcttcatacagacctgggcgaacacgagcagggtggcgatcaggggcaggtacgcgaggccggtctgcagcgcggagaacccgaggatctcctgcaggtacagggtgacgaagaagaagtaactcatctgcgtggcgccgaagatcgccatgatggcgagcgcaccgctggtgttgcgcagccggaagacctgcagcgggacgaacgggtgcccttggcggcgttcgacggcgaggaacacggcgaacagcacggccgcgaccaccagcaggccgccgcgcagcggagaggtccacgagcgctgcgtgtcgaggaacgcgaagacggtcatcagcagcgcggcggtgaacgtcaccgcgcccgccacgtcgatcgagggccgctcatcggcacggctctccttgatcgtggtggcggcgagccccacgaccagcgccccgatcgggacggcgacgaagaagctgaactcccagccggggcccgacgtgagcagtccgccgacgatcagaccgaacagcgcgccggccgcctgagcgctcccccacagggcgaacgcccgctgccgcgaaggcccttcctcgaacgaggtgatgatcagcgagaggacgacgggggcggtcagcgcgccgcccatgccctgcaccgctcgcgcgatgaccatgaccgtcgggtcggtgctgaatccgcagacgacggacgccagcgtgaacacggtgacgccgatgatcagtacccggcgcctgccgaacaggtcaccgatgcggccgccgagcggcagcagtccgccgtacaggaggccgtaggcgttgacgacccagggcaggcccgactcggtgaagtcgagatcgcgctggatgaagggcagcgccacgttgacgatggtctggtcgacctggatgagcagctcggccatcagcagcgtgacgaggatcagccgggcgacgagtgcgcccgtggcggggctttgctcggcggcctgccggccgtcgtcggtcctgacggtcatggctctcctgatcttcgtgccacacccgccgcttgggcaggctcggtcgaggccacgttagggacggggagcccgagccggatgctcaatacagcgcatcgccggtgggggatcgaaagacctgccgcaccggcgcgcggcgcctgcgacacaccgcgggggttcgccccggcccccgcggtgtccgaccccgtcgtcaccactcgacgtgcatcacgcgcggagcacgaatgatcatgtccgccttccattcgacgtcgccgctgagccgcaggcccggcatgccctcgacgagggccttgagcgcctcctgcagttccacccgggcgaggtgcgcgcccaggcagtgatgggcgccgtggccgaagaccatgtgccggttgtcggcgcggtcgatgacgacctcgtcggcgttgtcgaagacgaggccgtcgcggttcaccgcgctcgtgtccacgatgaccggctcgccctcgcgcacgaggacaccgcccaccgtcatgtcctcgagcgcatacctcggagagatgccgttcgcggcgaacgggacgaagcgcagcagttcctcgacggccgcgggaatcgcctcggggtccgcgcacagtcgcgtccacagctcgcgacgctgctggagcacatggacgaagctcgagatctcactcgccgtcgtctcgaatccgccgatgaggatcgagatgcacaggccgatgagctccggctcggcgagccggtcatgggcgtcgcgcgcctcgatgagggcgctcgtcaggtcgtcccgcggctccgcacggcgctccttgaccaggtcctcgaagtacttctgcagatccatgaagctctgcacacactcttcgtcggtcagttcgcccgtggacagcgccgcgtcgcaccatccccgcagccgggtcctgtcgtcctccggtacgccgaggagctcgcagatcacggtgacggggatggccagcgcgtacgagccgaccagctcggcgggcgcaccgccggccttcatgtcggcgacgagcccggcggcgagctcgccgatccaggcccgcttggactcgatgcgccggggggtgaaggccttggagacgagcgtgcgcaggcgggtgtggtccggggggtccatcgtcaggatgctctcgggcacggcccgcggcgtcatgcgcggctcgtcgcgctgggtggccaggtgacgggagaaccgccggtcggtcaggacgaaacgtgcgtcgtcgtaccgcgtgacgagccacgcgggctcaccgaacggcagctgtacgcggatcgggtccccgtcctcgaagagcttcgcgtacgactgcgagagctcgagcccctcgcttccggtgaaggggtacgcgaccggtgccggcttctcggtttccacttcggtgctcactgtcgactgcctcctcggaaatgcccgccgtgacgcggcgtcacgctaacggcccgggccgcggcggcctgctcaatccggagcatcgggcggaagtaccgggcgggatactccgcacatgactcagatgcggattcaggccaccttcgtcgtcgacgtctgggacggcaccgacgacgagccggtcgacggcggcccggtcaccggtcgcgtcgaactgaccaagacctacacggaaggcgatgtgaagggctcggccaccggccacatggtgaccacccaaggccccggcggcgcggcctacgtggcgcaggagcgggtcaccggaatcatgggcggccgcaccggaacgttcgtcctggagcaccgggcgacgcaggtcccgggcaccgacccggtgacgtgggcgggcatcgtgccgggatccggcaccggcgaactggccggcgtcagcggcgagggctcactcggccacggcacgctcgacctccaggtcgagttcgccaccgacggggctgcctagtccgcggcgcgaagggccgttcagcccttcccggccgccgccaggatcttctcggaggtgtggaagaaccgccccgtggcctgtaccccgaaggtcttctcgatggcggggaccgggttgacggggcggccgttgaccagccgccaccgcacataggccgtcgccccgcaggcgccgaggacttcccagtcgcccttggcggagcgcagcgggaactcgccgtccgtcagcgggcccgagctgtagaccatggagaaccgctcgtccggggccggctgccggcccacgaacggggacgctgccagctccgtgcgcagttcgtccgtcgtgcgcaggatcgtggggacctcgaacccgaaggcctcggcgagaccggcctccacgcgctcgacgatgcgggcgcggtcgttccccgcgccggtgaagaaggcgttcccgctggcgatataggtgcgcgcgcccatgaatcccagctgggtgagcacctcacgcaggcgggccatctcgaccttgcgcccgggaacgttgacggcccgcaggaaggcgatgtacgccggaccggtctgcccggccggagcagtcgcatcggtcgcatcgctcggaacggtcctcatgtgcgtgcgggttccttcctcgttgccacgtcgcgcccggccggagccgggcgccatgttctcacgcgtttcagaacgtccgctcggccaccgggaagcggttgtgcgccgcgttgcagcggatcagatcgtcgacgaacacgttgagcagaggccgttcgtccgcgtgccagtggaagtggccgccggggaggcggcgggcgcggaaggagcggcgggtgtagtcgcgccagccgcccaggtccgcaccccgcaccgtgaggtcgtcctgccccgccagcgccgtgacgggggcgtgcacagtgttgtcgagtccttcctcgtacgactccgcgagcgcgaagtcggctcgcagcaccgggagttggagcctcgccaggccggcctcgccgaacgtgccgggatggatacgggggtggtggccggcgcgggccaggaactcctcgtccggcaggtgcccgatgggctcctcgcgcgggggcaggtgaggcgccgggtacccggagacgtacagccgctcggcgaccagttcgtggtcccactccagacgggccgcgatctcgtaggccagtacggcgccgaagccatggccgtacagggcgaagggccggtcgcacaggcgggccacggtgggcaccagatcgtgcagcagcggctccaggcggcggcgcggctcctcccgcatccggctcccgcgccccggcagttcgaggggggtgacggcgatgtgcggctggagacgctcgcaccacggcagatagacgcccgctgaggcgccggcgtacggcagacagaacaggcgcaccgacgtgccggtcatgcggaggccgccggggtgggagtgagggcggtcgatacgtcgagcacggtggttcccctctcggtccacaagcccctttcgcagggctgatgctgccgccggaccctacggaggaaatgcgccaactcccgttttctgtagtgggtttggtggtcggctccgagtgcttgtgcaccgcgggtcgatgtccgttgcccgcaccgagcgaccccaagggcgcgtgtggcagatctcgagcgcctctcgagttgccgtccatagcgtcccctcggggacgaccaggacccgagagaggagtccggatgaccggcacgctcgtgcgcggcgccgcccgaacacgtccgcgtctgatggcggtccacgcccaccccgacgacgagtccagcaaaggcgcggcgacgttggcgagatatgccgccgagggcgtcgaggtgctggtggtgacctgcaccggaggggaacgggggtccatcctcaatccggggtacccgcgcccgcgcgggcccgtggacatgtccgtgctgcgcgcccgggagatggagcgggcccggcggattctcggtgtgcggcactcctggctcggatatgtggactcggggctgccacagggggacgaaccgctccctgcgacctgcttcgcgcgcgtcgccccacaggcggccacggcccgtctggtgcggctgatccggcagttccggccggatgtcgtcacgacgtacgacgaggacggcggttatccgcacccggaccacgtcatggcgcaccgcatcacggtggcggccttcacggcggccggtgacggtgcggcgcatcctcgtgcggggcggccgtggcaaccgctcaagctgtactacaaccacggctcgcatccggcgcgcagcgcggcgctgcaccgggcgctgcgggagcggggcagcacggcaccgtacgcgccgctgcccaacgagccggtgcggcagccggacatcaccacgcgggtgccgtgcgccgagtacttcccactgcgggaccgggcgctgcgcgcccacacctcacaggtggaaccgcacggcgtctggttcgccgtgccgacgccggtgcagcaggaggtgtggcccaccgaggactacaccctcgcgcgatcgctggtgcgcacggagttgccggagagcgatctgttcgccggaatcgccacggcggccaccgtcggacgccgcggcgtcggcccgcgtcagatcagggcgcgccgccccgaagggctccgggtgaagatgccggcggacgcggcgagggccgcgctgcgggccgcctcgtcgggcaggagcgggtcgggttcggctcgcagcaggaccagttggtgatagagcggcgcggtggcggcgacgagcagggggcgtgcggcggtgtccggcggaacgtccccgcgctcgacggcccgctcgacggtgacctcgcagcgcgtgtagcggtcgtcccagaaccggcgcagggcgcgggcggcctgttcggagcggaacgacgcggcgatcagggccgcggtgaccgacggctgctcggacagggccgtctggacgtcgtggttcagtgccgccaggtcgccgtacagcgtgccggtgtccgcgggctcccagtcgtcgcccatgccggcgttcaggacgtcggcgagcagcccgccgacgtcaccccagcgccggtacacggtggtgcggtggactcccgcgcggtccgcgacggcgtccaccgtgagtgcgtcgtagccgtgttcgaccagctcgctacggaccgcgtcgagcacctgggcgcggttgcgggcggtgcggccgccggggcgtcggaccgggggcgccggggcggcggtggtggcggtggcggagccggatgcggcatgtggggcggcagagtcggtatccggtattccggttgctcggggaggcggtggcatgacagcatcttaatgcaactgttgtcgtactagtggggtcgtcgatgatcttccgaagtgttcgcccggccccgcggccctcgccggccgctccgtccccgaatgcttcggagtcctcacatgcctacgcagatcagcgtccgctccgtcaccaagtccttcgacgaccggctcgtcctcgacgcggtgacgtgctcgctccccgcgggtgagcgcgccgggatcatcggggagaacggctccgggaagagcaccctgctgcgcctgctggccgggcgcgaccagcccgaccagggcacggtcgtcgtccaggccgacggcggcgtcggctacctcgcccaggacgaacagctcccttcgcgtgccaccgttcaggatgtgatcgaccgggccctgggcgacctgcgcaccatggaggagcgcatgcgtcgcctggagacctcgatggccgacggcgacgagagcggcatggccgaatacggagacctgatgacggtcttcgagctgcgcggcggctacgacgcggacgcccgcgtggagcgcgccctgcacggtctcggcctggacctcctcgaccgcgaccgcaccgtggacggcctctccggcggagagcaggtgcgcctgcgcctcgcggccgtcctggcggccggtcccgaggtgctgctcctcgacgagccgaccaaccatctcgacgaggacgccctgagctggctggaggaccacctgcgcacccggcgtggcaccacggtggcggtctcccacgaccggatgttcctcgagcgggtggcgacgagcctgctggaggtggacgcggacagccgcggcatcgtgcggtacggcaacggctacgccggctatctcgccgagaaggcggcggcccgccggcgcgccgcccaggcacacgcgcagtggcaggccgacgtggcccaactgcgcgaggcggcggcgacgaccgcccggcgggtggcaccggggcgagcgatgaaggacggcaacaagatggcctacgaccgggcggcgggccgcgtgcagcagtccctggccagcagggtgcgccaggccgaggaacggctgcgccgcctcctcgccgacccggtgccctcccctccggaacccctgcacttcgcgcccgtactgcgggcggcaggcgtgcagggccccgtcctcgacgcggccggcatcggtgtcgccggccggctcgaccgcacggacctcacgatcgcggcgggcgagcgaatgctgatcaccgggccgaacggggcgggcaagaccaccttgctgcgcgtcctggccgacgagctggcgcccgacaccggttcggtcacccgccggggccggatcggctatctcccgcaggaaccgggtcccggccgacccggcgagagtctgctcgccgccttcgcgcgcggccgctccgggcagaccgccgagcaccgcgaacgcctgctgtccctcggcctgttcgacgccgagcagctcacggcctcggtgcggggcctgtccaccgggcagcgccagcgtctcgccctggcacggctcgtgacgcagccgtcggacgtgctgctgctcgacgagcccaccaatcatctttcgcccgcactcgtcgaggagctcgaagcagccctggccggctacgacggcgctctcgtggtcgtcagccacgaccgccggctccgacggcgctggcagggtgctcagctcaccctgtcgacgaatgcaccacaggccgtccgggtctgagacacggacgtccgcacgcaccaactcgcaaggagtcacccatgcttcagtccagcgccgtgttcaagcaggtgtccgtcgcggaccctcagttccgtccggcccctacgacgtcaccaccgggccggacgacgcgctgtggttcaccctgatccactccggaggcatcgcccgcctcacacccgacggcgcgctcgaccgtcatgcgctcgactccccggcgtgcggcccctcgatcatcacgccgggcccggacggggccctgtggttcacccgttgccaggaccatcgcatcgggcggatgacggtgacagggcacgcgacctctttcgccgtcgcgacgccggacagcggcccctacggcatcgccgcgggcggtgacggcgctctgtggttcacccagttgcacacggaccggatcggccgcatcaccgtggacggccgggtgaccgagttcccgttgcccttcaggggcgcttttccctcggccatcaccgcggggcccgaccaggcactgtggttcacgctgaaccgggcggacgccgtggggcgtatggatctcggcggagaggtcacggtccacccgctgcccaccgagcacgcggcaccggtcggcatcaccgtcggcacggacggcgcgctgtggttcgtcgagatcggcgccggtcaggtcggacgggtgggcaccgacggcgtagtccgggagttccctctcccggaccgcgcgtgccggccgcacgcgatcaccgccgaccccgccaggggcgtctgctggttcaccgagtgggctgccgaccgcatcggatcgatcacgcccgacggccacatcgaggagtacgaactcccggaccgcggcgcggaaccgcacggcctcacagtggcgccggacggtgcgctgtacgtcgcactggagacagggcggatactgcgcatggagctctaggaccggcttgtccggcgggtcgtgcccacggccagtccttcccgcgaacgctcttcgcccccggccgacggcgcgggggcgaagctctgttcacagggtcttttcatcagggctcttcacggtgtcaccgcttcaccacggacctcctccggtgtggtgtcgcgcagttcaccgtcgagcaggacccagcgggtgatcccgatcgactccaggaacggcacgtcgtggctggccacgatcagggctccctcgtaggacgacagggccgaggtcagctggcgcacgctcgccatgtccaggttgttcgtcggctcgtccagcatcaggagctggggcgccggctcggcgagcatcagcgcggccagggtcgcgcggaagcgttcgccgccggacagggtcgcggcctgctggtcggcgcgtgcccccttgaacaggaagcgggcgaggcgggaccggatgcggttgttggtcgcctgcggtgcgaaccgcgccacgttctcggcgacgctcagggcctcgtcgagtacgtcgagccgctggggaaggaagcgcagcggcacgtgtgccacggcctccccctccacgggttcgagctctccggtgatggtgcgcaggagcgtcgtcttgcccgccccgttgcgccccacgagcgcgatccgctcgggcccgcgcagctcgaactcgccctgcacccgggcgccatgggcgaggtgcagttcgcgcagggtcagtacggtgcgccccggcggcaccgcggtgtacggcaggtcgacatggatctcgtcgtcgtcgcgtaccgcgtccaccgcctcgtcgagccggtccttggcctcggcgagtttctcctcgtgcatgatgcgatgcttgccggcggcgacctgggcctgtcgtttgcgctcgcccatgacgaccttgggctcgcgcttggtgtcccacatcttctgtccgtagcgcttgcgccgcgccaacttgacttgcgcgtccgccagttcgcgcttctgcttcttcaggtcggactcggcgacccgcaccatccgctgtgctgcctcctgttcggcggccagggcctcctcgtacgcggacagattgcctccgtaccaggtgacctcaccgcctcgcaggtcggcgatctggtcgacgcgttccaggagttcacggtcgtggctgaccaggaccagcacgccggaccacgcctcgaccgtggcgtacagccgccgccgggcccggaggtcgaggttgttggtgggctcgtcaaggagcagtacgtcgggcctgctgaggagcagtgcggcgaggcgcaggagcaccgactcgccgccggacacctcgccgatggtgcggtccaggccgatgtggccgaggccgagcccggacagcatggcgacggcgcgctcctcgacgtcccagtcgtcgccgactgcggtgaagtgttcctcgctcgcgtcgcccgcctcgatggcgtgcagtgcggcgcgggcctcggcgatgccgagggccacgtcgacacgcagggacgtgtcgagcgtgacgttctgcgggagatagccgacctctccggtcacccggacggtgccggaggccggggtcagctccccggcgatcagcttcaacagggttgatttccctgacccgttgaggccgatgagcccggtgcggccgggcccgacggcgacctgcaggtcctcgaagacgggcgtgccgtccggccaggcataggtcaggccggcgcaggtgatggaggtggggccggagaagttcgggtgggtggtcatggggcctcgcggttgctcggtgcgaacggtggtgggggtgcaacgcgttcgagacaccgtgggcgcggcgacgacgggaggagatgccggattccggaccgcggcctgatgggcggcggcgcggggagggggacggctcgtgacgtcgaggtcgcacacaggagcgtccgcagtgccgggatgtacggcgtgagctgcgtgacgcgacggtgactcgggacctcagacgagcaacgtccttctcctatcgacggcagcagaatcgctatacagcgtatagcgatgggtgggggatgtcaacgactcgctctcgacgatgcactccatggctctgcgctccatgcgctcagtagcggtagtggtccggcttgtacgggccgtcgacctctacgccgatgtacgaggcctgctcggggcgcagcgtcgtcagcttcacgccgagggcgtcgaggtgcaggcgcgcgaccttctcgtcgaggtgcttgggaagcacgtagacgtcggtcgggtactcgtcgggcttggtgaacagctcgatctgcgccagcgtctggtccgcgaacgagttggacatcacgaacgacgggtggcccgtcgcgttgcccaggttcagcagacggccctcggacaggacgatgaggaccttgccatcggggaacttccaggtgtggacctgcggcttgacctcgtccttgacgatgcccgggatctgcgcgagaccggccatgtcgatctcgttgtcgaagtggccgatgttgcccacgatcgcctggtgcttcatcttggccatgtccgaggccatgatgatgtccttgttaccggtcgtggtgacgaagatgtccgccttgtcgacgacctcgtcgagcgtcgccacctggtaaccgtccatcgccgcctgcagcgcacagatcggatcgatctcggtgatgatcacccgcgcaccctggccacgcagcgactcggcacaccccttgcccacgtccccgtagccgcacacgacggcggtcttgccgccgatcaggacatcggtggcacggttgatgccgtcgatgagggagtgacggcagccgtacttgttgtcgaacttcgacttcgtcacggcgtcgttcacattgatcgccgggaacagcagggtgccgtcgcggtgcatctcgtagagacggtggacaccggtcgtggtctcctccgtcacaccgcggatctccgaggacatggccgtccagtcgagtccgctgcggtccaacagggcgcggaccacggccagttcctcgttctcggcctcgggcagtatccccgtcttgcggtactcgacacccttgtggacgaggagggtggcatcgccgccgtcgtccaggatcatgttcggcccggtgtggccgggccaggtcagcgcctgctccgtgcaccaccagtactcctccagggtctcgcccttccaggcgaagaccgggatgcccgcggcggcgatcgcggccgccgcgtggtcctgggtggagtagatgttgcaggagacccagcggacgtcggcgccgagggcgacgagggtctcgatgaggacggccgtctggaccgtcatgtgcagggacccggtgatcctggcacccgccagcggctgcgccgccgcgtactcctcgcggatcgacatcaggccgggcatctcgtgctcggcgagggtgatctccttgcggccgaaggcggcgagggacaggtcggcgaccttgaagtccgtgaagtcagcgggcggctgcgagggcatgtgtgctccttgaggtacggatgctctggatgttctcgtggatctcgagcgtcgcggtggaccggttgagggtgatgtagtgcagcccgggcgctccctcggcgagcagccgttcggccatggaggtggcgtactccacgccgatgcgatgtccctcggccgggtcaccggcggccgcttcgaggcggtctgccagtgcggcggggaagcgggcgttggacagttcggcgaagcggcggatctgccgcacgtcggtggccggcatgatctccgggatgatcggggtgtcgcagccggccgccgcgacccggtcacgcagccgcaaatagtcctccacgtcgaagaacatctgggtgatggcgtagtcggcgccggcccggcacttggcgacgaagtggctgatgtcgctgtcccagtcggccgagcggggatgccgctcggggaaggccgcgacgccgacgctgaagccgcccaggttcctgacgagccggaccagttcatgtgcgtgcgtgaacccctgggggtgcggcgtccatggcgcgttggggtcgccgggcgggtcgccgcgcaggacgaggacatcgcgcacgcccgcgtccgcgtactggccgatgatgtggcgcagttcggccaccgagtgccccacggcggtcagatgggcgaccgggcgcagggtggtctgggcggcgatgcgcttggtgacctcgacggtacggtcccgggaggagccgcccgcgccgtaggtgacggagacgaacgtcggcgagagggcttcgaggcggcggatcgcctgccacagcatgcggctgccggcctcggtcctgggcgggaagaattcgaaggagaaggtcggggtgccgctcgccagaatgtcgcgcagcgtgctcaattgcggcctccggcgttgaagtagctcgcttcggggtggtgcaggacgatcgcgtcggtggactgctcggggtgcagctggaactcctcggacaggacgacgccgatgcgttcaggtgcgagaagcgtggcgatcttggcccggtccgcgaggtcggggcaggccgggtagccgagcgagtagcggcagccctggtactcggttcggaacatgccgtcgagcaggtcggggtcaccgccgccgatacccagctcggagcggacgcgtgcgtgccagtactcggcgagcgcctcggccagctggacggacaggccgtgcagttccaggtagtcgcggtacgagttcgactcgaagagcttggcggtcgcctcgccgatccgggagccgacggtgacgacctggaggccgacgacatcggtctcgcccgactcctccgggcggaagaagtccgcgagacacaggtgccggccgcggcgctggcgggggaaggagaaccgggacagctccgagcccgcctcgtcgaggaggatgaggtcgtcgcccttggacacgcaccggaagtagccgtggaccacggccgcttccagcaggttgtccgtctgcagccggtcgagccagccgcgcaggcgcgggcggccttccgtctccacgagctcctcgtacgtgggcccgtcaccggtacgtgcctgcttgaggccccactgccccttgaacagggcgccctcgtccagccaggacgcgtactccttgagctggatgcccttgatcacgcgggtgccccagaagggcggctccgggaccgggttgtcggtggacgtgtcggagcgtgcgggcccctcttcgggccgctcctcgatctgtacgctgcccgccttcacccggcgctgcttgagctccggcagtgtcgcgcccggcacgccccgcttcacggcgatcagggcatccatcagacgcaggccctcgaacgcgtcgcgcgcgtaacggacttcgccctcatagatctcgtggaggtcctgctcgacatacgccctcgtcagcgccgcgccgcccagaatgacggggaagtcggcggccatcttgcgctggttgagctcctccaggttctccttcatgatcaccgtcgacttgacgaggagtccggacatgccgatcacgtcggcccggtgctcctcagcggcctccaggatcgcggagacgggctgcttgatgcccagattcaccacgttgtagccgttgttcgacagaatgatgtcgacgagattcttgccgatgtcgtgaacgtcgccacgcacggtggccaggacaatggtgcccttgccctccgcatcggacttctccatgtgcggctccagatacgccaccgcgttcttcatcacctcggcggactgcagcacgaacggcagctgcatctgccccgacccgaagagctcaccgacgaccttcataccctccaggagggtgtcgttgacgatgtccagcgccgggcgggactgcagcgcctcgtcgaggtcggcctccaggccgttcttctcaccgtcgatgatgcggcgcttgaggcgctcgtccagcggcagcgcggccagctcctcggccttgccggccttgagagacttcgcggtggcaccctcgaacagcgccatcaacttctgcagcgggtcgtagccctcggcacgacggtcatggatcaggtcgagcgccgtctgcacctcctcctcgctgaaccgcgcgatcggcaggatcttcgacgcgtgcacgatcgccgagtccaagcccgccttcacacactcgtccaggaacaccgagttgaggaggatacgggcggccggattgagaccgaaggagatgttggacaggccgagggtggtctgcacgtccgggtagcgcttcttcagctcccggatcgcgccgatggtcgcgatgccgtcgccgcgcgactcctcctgacccgtacagatcgtgaaggtcaggcagtcgatgaggatgtccgactcatggatgccccagttgccggtcaggtcgtcgatcagacgctcggcgatggcgaccttgtgctcgacggtgcgggcctggccctcctcgtcgatcgtcagcgcgatcagagcggcgccgtgctcctgcgcgagccgcgtgaccttcgcgaaacgcgactcggggccgtcaccgtcctcgtagttcacggagttgatgaccgcgcggccaccgagcttctccagcccggcccgcagaacctcgacctcggtggagtccaggacgatcggcagcgtggaggccgtggcgaaacggccggccagctcctccatgtcggcgacgccgtcacggcccacgtagtccacgcacagatccagcatgtgcgcgccctcgcggatctggtcgcgggccatctccacgcagtcgtcccaacgggcctccagcatcgcctcgcggaacttcttggagccgttcgcgttcgtccgctccccgatcgccatgtacgcggtgtcctgacggaacgggaccgtctggtacagcgaggcggcacccggctccgggcgcggctcgcgaacggcgggctgtacgcccctcatccgctcgacgagccggcgcaggtgctccggggtggtgccgcagcagccgcccaccagggacaggccgtagctgttgacgaagttctcctgcgcgtccgccagttcggacgcggtcagcgggaagtaggcgccgtccttggtcagcaccggcagtcccgcattcggcatgcacatcaacggcgtcgtcgagtgctgcgcgagatggcgcaggtgctcgctcatctcggccgggccggtcgagcagttgaggccgatcaggtcgatgcccaggggctccagggccgtcagggccgccccgatctccgagccgagcagcatcgtgccggtcgtctcgaaggccagggagcagatcaggggcagtccgacgcccagtgactccatggcccggcgggcgccgagcagaccggccttggtctgcagcagatcctgtgtcgtctcgacgatccactagttcgacc

SEQ ID NO: 2 - protein, 289 aa, Streptomyces atroolivaceus
MEMSDTSRAIAAAISIAASLGLPADDAIVLHNSNKLALRLTPSDVLARVAPVGQEVAHFEVELAQRLAEFGSPVGLLEPRVDPRVYTRDGFAVTLWTYYEPVTPHVSPADYAEALERLHAGMRKVDVPSPSFMERITEAQEVVASLDLSPGLADADRVLLSGRLGSLRRAIEGRGAVEQLLHGEPHPGNVLSTKKGPLFIDLETCCRGPVEFDLAHAPEEVCKHYPNVDQGLLDDCRQLVLAMLAAWRWELGDQFPNGKRFGEEFLRLLREGPPWPTFDAVTRRLGSGQ

SEQ ID NO: 3 - protein, 502 aa, Streptomyces atroolivaceus
MSDFSRRRLLKTSAVAGAGAVVVPGVAAAATPSAGVVTEASVNEAYEAQCSPAKLTGRIVRPHDPGYTDARLGWDQLFSHYPLVIVFAQNTQDVVNALTWARQNDVALRIRSGRHSLEGWSNVDSGLVIDISELKSVHLDSAARVATVGAGLNQLEAVTTLAKRNFAVTTGTEGTVGLAGATLGGGFGFLTRWLGMACDSLIGAEVVVAEGGECAKVIKADLTHNSDLLWALRGAGNGNFGIVTSLTYKVAPLKSVTYVQATWDGIGDLRRVFNAWQRTALHADDRLGTQVEIHRNQTLLFAVLAEGTPAEAKKLLAPILSVGSPQVSVQVGNWGEVYSGFQIPTANEPANWKFYSQFTRKPFPGKAIDVICSFMKHAPTDDSNFFTQAFGGAVRRSPRGGTAFPHRDALFYSEPGAGWGTRSDQPGICDPLTPQAQAWIAEFSQALRPYVDGAYVNVPNVGMQDWETAYWRGNFDRLREIKAKYDPHNVFQYDQSIPPASR

SEQ ID NO: 4 - protein, 1237 aa, Streptomyces atroolivaceus
MPKLPIPRPGPIALAVAAALTLGVIPATAAVSAYSSGEVSHNDAGHRTPGDAGTHTVTLITGDKVTIGTAADGTVVRSFRAASGATTGFHRAVVDGATYVYPDAALPYVSAGKLDKQLFNVTRLITEGYDDAHSSRLPLIVRYTGAAAKARTRTKMAGSTDVRRLDSIQGAALAQNHKQAPEFWSSLTGGSGAAARSAKPSFAGGVAHVWLDGRVKADLADSTAQIGAQKVWAEGDTGQDVKVAMLDSGADTEHPDLVGQVSDSASFVPGEDDIADYNGHGTHVASTIVGTGSASDGKERGVASGARLSVGKVLNSEGSGQESWIIAGMEWAARDQKARIISMSLGGGGDKNDPMSQAVDELSHDTGALFVIAAGNGGPHSISSPGAADSALTVGAVDSTDTLADFSSQGPRDGDGGLKPEITAPGVDIVAARSHYKRGSGYYTTMSGTSMATPHVAGVAALLAAEHPDWTGTQLKEALVSSAKATPAYTPYQAGAGRLDAPAAVHTTVFATTTAYSGFHTWPPKPGETDVRTVTYTNVGDAPVSLNLAVNGTVPAGLFSLSEDHVTVPAHGTATVTLTAALDKLAGDQSVSAVITGTDGSGAVRARTLIGAAREGQRQNLTVVAKDRAGKPLAGRVVLTAEHLFTVMDLDASGTGTTRLPVGSYSGWLTGDVQGAEGPNSLGMVLLAFNDVKLDQDRTVTLDGRKARRILARVPQQTTAVAPRLDAHRSFTDSLVETSMLPNSSYDSIWALPTGKKVTDGEFEAGARFRLEQPALTLNTKSTTFNDPLVKRAATPLPAGSRNLTAVFAGDGTAEELARQNVRGKAVVVRGAGTEGIKAQAEAAAAAGARLLLVVNDGVGRLQPWVENPWSPQSPAPVTVATLTADQGAELIGSLRHGAVSLKVTSHPTTDYVYDVVHHWTGAVPADPTWREESKDLGRVNVSFRNYRQGKAMEFRPDVWRGWAVGNQLTAPAQGERTDWVTSGTTWLDDAFIQGETGQHSIDPLQYSARKTGKVNWFGPIQRPRMGPVNYQPVRYLDTMYITAPGWGDSGSGHVGEAGANFDVKDWMSLYQGDQQLDWGNAEYLQVPGLGAERLPYRLVLDNNRGAWANPYSTHTLTEWNFTSAVTSSQSAVSLPLIQLDYGVDTDKSGRADRHAGLTVTASHLPGTTAAIAKPSVEVSYDDGATWQRTGLSRCGDGWRTNLRAPRSAGFATLRVGARDNAGNTVSQTITRAFGLR

SEQ ID NO: 5 - protein, 262 aa, Streptomyces atroolivaceus
MADEPASPAVGRLRHPPGRRPGQRGQHRLADDHPGLRPALTSQPGRSPGTAPCGWDRSRRPHPHGIPSRQRIYEDTPSRNGKRVLVDRLWPRGMSKARAHLDEWIRDVAPPAAGRPSASLLPETWRPTRARRVPGQTIRTAAGFTTHSACTRSGAAGEGVDRFLPVVSPAGWVGSLGSAERERRRSALSQAVVSDSMGCGVCTKTPRSGSRPTLWPYSPTRRPVGSLRLFGMCRASHPAPVTSKPPAPILWASVSEARRTER

SEQ ID NO: 6 - protein, 401 aa, Streptomyces atroolivaceus
MSARQETSTATAHHVVILGAGYAGMSAAIQLAARVKGREDVQVTVVNAQERFTERMRLHLTATGQRLAELSIPELLEGTEARFVRGWVTAVDADAKTVRIDDDRVLPYDTLVYGLGGVADTCTVPGVEDHAYTLSSAQDAELLAVRLGRLGSGTVVVAGSGLTGVESAAEIAERHPELDVVLLGRAEPGATMNPKAKAYVQAALDRLGVRVRAGAEVVKVLSDTVELAGGESIAADVVLWTSGTRASPLAAAAGLAVDERGRIVTDAALRSVSHPDVYAVGDAAAIRQGYGVMHGTCQGGMPTGVHAALSIECVLKGKQPKPFRFGYYHTPVSLGRGDAVVQFTHPDDSPRRICLTGRMAVRYKEMVTASPWPTYGRMKKMPASGAFWPRGGRSARVREAR

SEQ ID NO: 7 - protein, 306 aa, Streptomyces atroolivaceus
MTDPTAHPGQQAFHEYRKLLFSVAYRLLGTAADAEDVVQDAWIKWSAADRSQVADPRAYLTRIVSNLALERLRSTRHKRETYMGPWLPEPILTGGDASEAVTEAESVSMAMLVVLETLSPLERAVFVLKEVFDFSHAEIAEAVERSEAAVRQAAHRAREHVRARRPRFATDRSRQCEVTERFFAAATGGDINTLMELLSPDVTLWTDGGGKVRQAMRPVVGAATVAAWFAAIGTVAYQGVEPADMKAELVEINGGPGMVFSGLGRVIATVTFDFDANGRITAIHNVANPDKLQAIADGTARDVGTR

SEQ ID NO: 8 - protein, 327 aa, Streptomyces atroolivaceus
MVANEGVAVVGADVDDRGWSDTRAWVEKRVGGGCRIDAAERLRGGWTSEMRRLRTGGTGEPQWMVLRSFVKPFFVQHAKGLLTREAEILRLLSETDVPVAEFHGVDATAVYCDHPSLLMSLLPGSVRLGEEEAGLRSQLLARQLVGIHQVRVPVEARPRVYQAWTSPDRVRLPESTERLDLWQRAVDIIRRDPPDYRPCFLHRDFHPGNVLFTGQGARSEITGVVDWVEASWGPADLDVAHCSTALALLHGAEEGMRLADLYLASGGTLSEDPAAHLYWRVLDALAFAPDAEKVAVPWRELGRKDLTSDLLTSRLEEYLEELFRRFG

SEQ ID NO: 9 - protein, 198 aa, Streptomyces atroolivaceus
MGRVSQAQAQENRQRVVATASRMFREKGTAVSVADLMKAAGLTHGGFHKQFASKDDLVDEAIAHAFAEHAAHSAATFEERAGEHEAARRTLIEQYLSVWHRDHAADGCPVSGFAADLGREPDQAARARHVYINGIRNRAARLATGDDDGMAQLCTMVGALALARATRGDPISEELLQAARTALAESGTKQSEPQQRMD

SEQ ID NO: 10 - protein, 538 aa, Streptomyces atroolivaceus
MASPPTPSESSTPTRSTPPVPPAQRRRVSEAVHHRRWAILAVLAFSLLVVMLDNSILNVAMKTIAQPAPTGLGSTQSQLEWAVNSYTLVFAGLLFTAGLLGDRLGRKKVLLFGMLVFGAGSALSALSDSSGQLITFRAVMGLGGAFILPATLAIIMNVFEREEQPKAIGIWTGVVGFAIAAGPIAGGVLLEHFWWGSVFLVNVPIVVAAIAAMAAIVPDSKDPRPSRLDAVGVLLSIVGLAVLVYGIIKGGQLGDFTRPEAWATILGGLAVLAGFVVYEAHSDHPALDVTYFRNRRFSASVAAIGLVFFALMGVTFFSVFYNQSVRGYSVLQSGLLVLPLALSQMFFAPRARLVVDRYGARAVCAGGLALTAVAFTGFLLLDQDTPIWVLEVLFFLMGTGMAHVMPPATVMIMSSLPREKAGSGSAVNNTFRQVGGAIGVAVLGSLLSTTYRNGIDGHLGTLPAADRHAAGESVQATLAVAEKLGPAGSALVRPAHDAFIHAMHITAAGSAAVALVGTVVVLVFLPGRKVTAATGGDK

SEQ ID NO: 11 - protein, 300 aa, Streptomyces atroolivaceus
MTADNLVLIPGAGGVGRTVFEHLRAQDVPVRFMVRRDDERAAELRALGAEVVIGDLTRPETVAAALQGVARMHFGISVSPDQLLAATVVASVAREYGELEALVDLSQMTVSQMTATSTEESHQQRLHWLTEQMLDWSGLPVVHVRPTAFLDNPLFTTIAARSIQANGTIALPFGTGRTSPVAADDVARTIATVLRDPAPHIGQVYELTGPRSVDMTELAAEFSRALNRPVSYVDLPLDRWEAQLPKLGMSPHVAQHVATMARLHRDNRYDRTADGVERVTGTPAMSIEAFVAARRDLYLG

SEQ ID NO: 12 - protein, 197 aa, Streptomyces atroolivaceus
MTLDDLLLPDTPVCTAATDVARAYCSPALLNHCVRSYIWAAVHGAEQDIAFDPELLYVGAMFHDIALVPEFDSHTVPFDDASAHVARVFAAGAGWSESRRERLAEVVISHMLDEVDVTKDPEGHLLERSTSLDISGRHMDDFSAAFKAEVLARHPRAGIAEEFLACFRDQAERKPGSSPATALRDGIAERILTNSLD

SEQ ID NO: 13 - protein, 353 aa, Streptomyces atroolivaceus
MTTLTFAEASAHSGGDLRYLPAGHGEVLDLSTCVTRSGPSPRALAAAAAFDPSSLTVHPYGADDRFRTTYAAYLGVDARQLAVTRGISEPLSVLASLLPAERSAALTPDYTGTIRRWARHLPPAPDERDCVDSRVRRLDAAMRHYAYVVFSNPNNPLGLTVPRDVLAELLSRHPRCTLVVDEAYVDYMGDRRQSAMTLPHRNLAVLASPGKPLGIAGTRTGVLWTPDDVLRERVARRLPEWPLSAYDAHVACAALQDTAWIASALEGAREDARRLEAVLVRCFGDAVVTGVPVHYRFVYDERPERLHAHLLADGIATRLLVDDEPGRVRGLRVLAPGSGELARLEASLNAFVR

SEQ ID NO: 14 - protein, 774 aa, Streptomyces atroolivaceus
MEFSSRSSTSSTTGAPLLSVRSAGEIVPVLCPDGFEVGGGPRVVEVVADRWAGKSTVLDGLSAALAGRGWTVAAGAASPARSRAPFGVFVEALEELVEHLDPDRLGGRGRDHAAQLAALFPALSPDAPRDTSVDTYRICRAMRALLEMLAADGPLLLALDDVHWMDADSLELLGQLLEQPVAGPVVIAVAHRGRPGDRVLNGLLARCASRGGCLRVRPAPLTEQEAIALLPDDLSRVHCETLLVESGGSPGLLRAFATLRQVPGLTGAWTPPLPADLLADVLRDFRALSAEGWQVVRAAAVLHEPYAADDLKEIAHVDDAALWRALDELIHEELLRPDELPWQLRFANPLLRVAAYQSAGRGWLLGAHAQAARILARPGYPSAHMARHLERGAALRDESGARVLWDAAARLLWQDPSQSVSWIRAALASRAGGDLEPRDRLLFGKALALAGRLTESLATLGPFGQGGVEAGLRVERVRWRAHAHRLLGHTDRAQDELESLLAELEPGEEGLRDVVRHALIELALHGRRPVPPPPGGSEPGMPQGATGALRGRLLAQLAVAACRGGEQERAEQRALTARQLLDAAPDGEVAEQLEGLYWLATAEAALGRPSAACGHYERGLRIAETRRLIDHVPLFAMALSALQLHTGDGAGAARHAACAETVAAATESEHLRERALRLRRETASGAGVAVLPGQRQPADAAAVALEGLSRRESEVALLVSGGRTNQQIARVLELSHKTVETYLGRIFQKLQVQSRAEVAAMVGRSDRLGVAAGS

SEQ ID NO: 15 - protein, 1105 aa, Streptomyces atroolivaceus
MQTQLSQGAQLSAEQRKLLDQLLDADGIDRVAGKVTRRTGDLSRAPLSFGQERLYFVDKLRPGSPMYVGSGALRLRGALDVEVLRRSIALLVDRHEVLRTGVVEDGDGVEQRIRPAGTVQVELPVRGAASGEVADRVREAAAEGFDLSAPPLLRAVLLEITDAAEPEWVLVLSVHHIAVDGWSLGLLMGEMSELYSALVQGAEPSLAELPLQYADFASWQRGWLEQGIIADQLAYWSDQLSGVEATEVPSDRPRPAERSYLGDTVPLALDRPLTQSLRALTDSGQSTLFMALTAVWASVLGRFADRRDVVVGTPVAGRTRAELESVVGFFVNTLPLRVRIEDGDTFRTLLLRTREVCTQAYAHQDVPFERIVAELQSGRDASGQTAIARHWLALHNTPAPDLTMPGLMSEALPALIGTVRCDLSVQLAPDGQGGLSGRLEYSTELFDRATAKTLASAFETLIASVAAAPDSPLDELDMLAPQAREHIVRDLSGAARGALTGPWVPERFAAQVDAHPDTVAVVEADGGQLTYGQLDVLANRVAHLLTARGVGAEDRVGVLLPGGGALAAAVLGVLKSAAVVLPLDPGYPPARLAQLVEDGAPRLVLSGAGSTDLLPDLDVVDVTGEEVAGHPGHRPPAVATAPDAGAHLLFTSGTSGRPKGVLTTRAGLVNRLMGMERQFSVGAGDRVLCKAPLGFDVAVWELLLPLVTGATVVSCRVGGHRDLEYLRELIDRHGVSVCHFVPSLLEEFANAPAGAHPSLRLLLSGGEELPAPLAERILDRFGHAEFVNQYGPTETVIDVTSGRVSGPVPHRVPIGRPVPGAEVYVLDASMRPQPVGVVGELYVGGVQVARGYVGRAALTAERFVPHPFAHGQRLYATGDRARLLAGGSVEFLGRTDDQVKIRGNRVEPAEVAAVLRAHPQVSGSHVTVQRTGAAPRLTGYVTSDAANADELTEELREFLRERVPEAMVPAQLFVLRQWPTGAHGKIDVTALPQPSGERPGAQREFAAPVTDVQVRLAALCTELLEVERIGLTDSFFDLGGHSLLAIRAISRIRKEFGVGLQIGQFFKAPTLAGLAEAIEAKLAAADGKPAGPAPIPRIDRGAQRR

SEQ ID NO: 16 - protein, 1105 aa, Streptomyces atroolivaceus; identical to SEQ ID NO: 15

SEQ ID NO: 17 - protein, 330 aa, Streptomyces atroolivaceus
MTIEVHDAVAVSPVWEGRSLPALVRCESPGGALPAWVSAHRDEVDALARKAGAVLLRGFDVRGAQDFRAVMDALSPQVLAYGERSSPRSQVSDGVYTSTEYPADQPILLHNEQSYTAKWPTRIVFFCERAATEGGRTPLADSRRILARLRPETVDRFERLGVRYVRNYLPGISLRWQEAFQTDRVEDVAAYCARADITPEWVDEDHLRTVQVRPAVRRHPVTGERSWFNHALFFHVTSLDPEVSAGLLEALDEEDLPYNTYYGDGSPIESETLAELRAAYAAETTGFDWQPGDVLVVENMLVAHAREPFVGPRRILTAMADAIDAGEVPA

SEQ ID NO: 18 - protein, 335 aa, Streptomyces atroolivaceus
MTLTDLTPALEDGTVTVRPLHEEPFLLEIEAREPGLDLPRWVAGRKEELRAGLDRCGALLLRGFDVPDPQEFGRAARAFSPDLLGYLERAATRTEVADKVFTSTELGEDQWIPFHHEMSYSHNWPGLLYFFGDLPSPEGGATPVASERRVFPLIPAEVRERFTRHGVRYVRNYGPDLNESWQVAFQTTDRAEVEAYCRQSDTAFEWTGDDELRTTAVRQAVARHPRTGETVWFNHAHLFHLSNVEPEVAEILVEEYGEEGLPRNAYYGDGAPIENEVAELIRSLYREAAVSFTWRRGDVLVVDNHLATHAREPFRGDRRILVAMSDLHTELPAGR

SEQ ID NO: 19 - protein, 313 aa, Streptomyces atroolivaceus
MLLRPTTDADLARVTDFIVEEPISWIPADRYRAELAEGMYRPQWSWIAEADGDIVARALWWGQAASEHPVALDCLHVAPSVPDRAGLAADLLRAGHTAFGQAGAAQPPLYNLTLSNGWRDDPAVSAALAWRREAALAAGLTHEVERLRLEWTPGTGVPAESGRLTFEEAPDEEFLDAFRRVAEGSLDAETRQHLAAHGPSATARKELDFYLGCPGERAWWRLARTPDGAVAGFAIPSATPYNPNVGYLGVVPELRGRGYVDVLLAEITRSHAERGAELITATTDTGNAPMAAAFERAGYRNTQIRMLFSAPAG

SEQ ID NO: 20 - protein, 341 aa, Streptomyces atroolivaceus
MTQTAPLSPRDRPAATPEPASRPYARGYQSPAALRPVLRAAHHTRLATTAAVAVADQLVLIAAILAASWPGWWSAPAPAAAGVLMALTALILTGRQIRALECLVHEASHFNWSRHHRRANDRCATVLAGLPTGIRIARYRAEHLVHHSRLGTEDDPDLQRYAELDITGLDRTSRVGYARSLLVRIAAHQRGWYRSTSTDLPALLLPVGWALLVVSLPAALLWGAAAAAVAAGVWLTGFALVLPVLRFIGESSEHSYHDADTVFDSTITNIGPLQRRLIHPHSDGYHTVHHLWPGAPHHQLRLLHDELMSADPQGFAGRLRTRSRIVADPTPRTGPGSTPWT

SEQ ID NO: 21 - protein, 433 aa, Streptomyces atroolivaceus
MRPDMSEVAVEQLKFLATDDVRTVAEEFGTPVFVYDEATVRASSKTMSTLPNAFGLTVRYSLKACPGQAIIRLFDREGFSFDASSVWEARRAVLAGVEPGRISMTAQEAVFDENLRDLIDQGLQFDAGSLHQLEEYGRAYPGGAVAIRINPGFGSGLVGRLNSGGPQSSFGIWHEQLPEVKQIVEQYGLRLVRLQSHIGSGHHWDILVDAVRTMLSFARDFQDVHTLDLGGGYRVSALQSDPVYDHTEWARVVADELKQFAEETGRRLHTEVEPGTYLTALAGSLVTKVIDKADTGAEGNSFLKINSGLTEIARPSYYGVQHPIVSVPATGGAERAADDREEFNVVGHCCIAGDVLTAKQEELAPVPLGRTEIGDYVVIERAGSYCSSMSMKNFNSYPEAAEVLRRTDGSFDLIRSRQSIEQVIVNERIPEGL

SEQ ID NO: 22 - protein, 794 aa, Streptomyces atroolivaceus
MADTRTTPADLTAAEEPRPPAPGPPRPSPAMRALTRLLVPVLALAVALVGVLWTSLTPAPAPASAPAGSFSAARAYPHLAAVSGGPHATGTAAHDRARDEVIRRLRELGLGVRVEPGTSSDTGNGAAVTAWTQNISATVHGTHPSGRVLIVAHYDSAENSHGASDDGIGLATALEVARALKTGPAPRNDVTFLITDGEEPGLLGARAFVARDTAPAASTVVLNLEARGTSGRAVMFETGTGNAAVVPALGDRVPVATSLSDEVYRMLPNDTDFTVLREAGMTGMNFAVIGTSANYHTPQDDLAHFSRASLQDMGDTVLAAARRLGGADLSGTSHAGGATYFTLGPVLVRYPMGLVLPGALLAVAALGAAGWYARRRGAVRARKAALSAASLPLALLGAAAAVSAVWPVATWLRPQWTGFALGSPYTAGPLHLTAALLTATALWVWAVVMRRRVSALEAGAAVTGWLTLCTLLSAVWLPGASYLFLWPALTGAAGLAAAARIAPGSPWRGALATAPLVPCAALLVPVGALLFDTVPIAFAAAPALLLALALATALPAVPAKTRRRSLVTGTGLGTAAALAALGAALLAGAPTASRPAQVSLLYALDADTGRARWASSGAGDSAWLDHYVGGATTSLESTFPSLDQPSRWHTGPAPAATVAVPEVKVVSTTRAGDVRRIILSVRATDARAAEIGLYADAGGAAVVRAEVAGQSVPGGTNRPFASDGWRWGLLLAAPPTGPGTRVELTLRGTQPLTLRAVTRTPGLPGGTLSVPRPADVTWSADDSGLTLVSRRYVL

SEQ ID NO: 23 - protein, 432 aa, Streptomyces atroolivaceus
MAPRTPRFAYGYGRLWAATAASGFGDGTRTAALAVYAATLTHDPFAVALVAMAGKLPWTCVGPFAGALVDRLDRWRTLWICDVARVLVTGALVLLILTDRAGITALAVVSFLLTSITTLAENLSQAVVPDVTGGGSLDSANSRLMGGQLVSSEFLGAPLGTALFALGRPVPFAVDTLSFAVSAVLVFSIRLSGARPAPTAAGRLTARAVVAETADGIRWLWRHRVLRTVCVLVGALNFAVVAVLSIAVLYALNVLHISQRAYGLLLAVLAVGGLAGVLLAPLVTRAIGRARTLQLAFALCPLPFLIAGLTSLPLLAAGALAFVGAAISLATVVTTSLRQSLVPGELFGRVNGGYRFVVNGVSPLGGVAGGALAEAAGLRAPFLFAAALLAAATVTALLRLSPAALDAAGDDRPAPRTGQAVAAERTEAPERT

SEQ ID NO: 24 - protein, 1134 aa, Streptomyces atroolivaceus
MTETLPADASALQRAVAELSPERRALLARHLARGRAGSGISVTALPRTGEAQRYVASPGQQQLYYQYQLDPSAVNYLLPIAVRLRGDLDTQALERALAAVVARHEALRTRFATDPEHGVVQVVGTPDEVRVALGRGRARADEVPALLDRIARRPFDLSAAPLLRAKLWQLTDDPEAPDGRSWLLTLCVHHIVVDGWSLGVLVDELTEGYAAQLTGRPANLPELAVQYPDFAAAHHAWLAGDEAARQIAHWREQLDGVLPLELAGDRPRPARPTFSGAAVRIDLDAQLVERADRLGRTEKATPFMVLLAAYAVVLHRWSAARDLVIGTAVAGRTRPESEPLIGFFVNTLPLRVPVDGAASFRELLRATRDSSLDGFAHQDVPFPRIVREVGGERTSGRSALVRALFALRNVPLRHLELAGVRAETLNLPKTGSDIDLSLEFSPAEHGGGLTGWLSYSFDLFDQDTAERIARAVHQVLTAAIASDGDTAVRDLPVLTEEEHTTLALHWSGRDAPAPGGDGLLDAFHAHAAATPDATAVVADVPPPATGHRLTYRELDERAGRLAHLLRARGIGPEDRVALLLPRGLDLLVCLLAVLKAGAVLVPLESEHPAGRLAGIVADATPCLTLTDTRLAARLPEGTPVLTVEDLPALTAHHPATGPDVPELPASGAYVLYTSGSTGAPKGVLITRAGLASRLAGMCADLGLGADERVLHKTPLSADTSMWELLVALRSGGRVVLAAPGLGTDVDYLYSVLTRHAVTTCFFVPSALRPAIGLGGLPRAAALRLVISAGEELPADLADQLLLQVPHIRLVNSYGPTETTINIAEHTVTAPAASPVPIGRPVPGGDLYVLDGAGRVQPVGVPGELHAGGVQVARGYLGRPAQTAEVYVPHPFVPGARVYRTGDRARWRPDGTLEFLGRTDHQVKIRGFRVEPAEVETALRAHPQVADALVLADAAPDGGARLIGYVTVAPGQSAPDTPALRTHLRAALPSPMVPDVFVALDAFPLTPYGKIDRASLPRPGRGPAKERRAPADDLQHVLAGVWEQTLEITDVSVDDDFFERGGHSVLATIVVSSIRELFRLELPLHFFVEAPTVATLATLMRAEGAEAGIDVDRVAALVRQVQSMSHNEVQQKLEG

SEQ ID NO: 25 - protein, 276 aa, Streptomyces atroolivaceus
MRSVRTAAGALSPAAHRKGLDLVSETTTAAAQTRTVTAAVTGLSGWGGHLLTAPEVRRLTGTGPQDWARFARHWDDLTLDTFMKDGGTYRYRRYGHFRLDVRTGELTAQPHAPYFQDSALNPLNGGVQRSFDPLTEAFLADPLTAAVVHLLGDVFSRAEGVRLWDVKLHPFRIVTSPDQTGRPAPQGRHRDGGAYVTSLLVNRTNVSGGESSLYDDDGNQLFAVTLGEPGDQLLVDDRKVLHDVTPLAPVDPARPSHRDVLIVDFDPVAADAEGQR

SEQ ID NO: 26 - protein, 549 aa, Streptomyces atroolivaceus
MTADDSLTVVTSFAQQSLWLQHQVDPDRAAYNITAAVRLRGPLDSAALERALNAVVARHEVLRTDFALDGEDPVQVVRPERELRVPVLDAGPDDFLRYAGKVLFAPFDLRGGPLLRLELLRLGPEHHIALLALHHIVTDGASSAILLQELSHAYAAELAGVEPLWEELPIQYADFAVWQRDALSGAALDELTGHWTRTLAGAEPLALPADRERDADASGHAAVHHFTLPAALTARLEDLARAERATLFMVLLAGLDALLARYCGQEDITVVSPMAGRGRPELEGLIGYFVNPLLLRTQVSGTAGFAALVGRTRDTCLDAFDREELPFEQAVEVLRGHGAPGAESLRSQVMLVLQNTRPNHWHSAGIDFELIPADTSTAKSDLVLEVRPGADGGCTAALEYRTGLYDAATADRVARHFAAILEAACERPDEPLSQLLATTVPDGEIPAVRSGAAHGEAPAATEYVAPRTPLEEEVAGIWSALLGTERVGVHDNFFDLGGQSLLAVRLAARLRDEFGVEMTVRDLYADFTLEAVTWAVLQRMTADGEQAPA

SEQ ID NO: 27 - protein, 235 aa, Streptomyces atroolivaceus
MLSAAVLCFAPAGAGASFFHPWLGQREGLTVLPVELPGREKRFAEPECTELGALMDAVLPALRSATAGFDKVAVLGHSFGALLAYEATRALAAERDGLTLVASGATWPGTLRRGRITGLADDEFIAGIHTIAGYRHPALDEPELRDLVLPPLRTDVAMHENYVYVEREPLDVPVLAVRGDADRLVSADDLTEWERVTTGTVTVAELTGAHMYLVEEWPALLDLLAGHLLGAGTPS

SEQ ID NO: 28 - protein, 276 aa, Streptomyces atroolivaceus
MSGRLTGRTAIVTGAGRGVGRACATAFAAQGADLVLVDIAADLPHVPYPAATPSQLDHTARLCREQGAAVLTARADVRDAAACERVVADAVDRFGSLDVLVNNAGIAGPSGRIVHEVTEDEWAVMIDVNLNGAWRMLKAAGASMVAARSGSIVNIASTAGLVGYRNFAGYVASKHGLVGLTKAAALDYAPYRVRVNAVCPGSVRDGEAWEGRMLVEIGRSIGIEPADHEAEFITQMPMNTLVEADDVAGAALWLASEESRHSTGGVITVDAGYSAR

SEQ ID NO: 29 - protein, 920 aa, Streptomyces atroolivaceus
MSSNSPSVAARHAAVYAVAPGYSAEDCRAALAGAPWPGPGRLRLWAEPVPAPSDSPAALRRRTRELHGRHGGEGVRLTLLEYADGVRDLVAVTGPGDDGADRLDRAALAALGPARPLAGSGSPSDPGCRAVPVPGLGAGGAMATAWDLTAALLLIAARTRAQDEPVLDVAVHTTDGVRRVSLRVAALDEDQPVSAYRAWVREQAEQTSAQDGGGGPRLALDVDLRPRAVPAVRRLPALHARHPVTVRVTASDADGTPQVHCWTLPGTPADQLPTDFEQQLAVVAHQLLCGDQNLPLADVALHEPAERARILDLGRTPRAADSGPRRIDQLVRDRAERTPDAVALRDPQGEHTWTYGELVDRSDRFAAALRGLGVRPGDRVGVCLDRSAQLVSVLLAVMTAGAAYVPLDPTYPADRLAYTADDAGLSLVVVEDGGKDDGNAFADHATVTLPRLRELAAGQGAWEEPGTVGPDDPAYIIYTSGSTGRPKGVVVPHRNVGRLLDATADDFRLGPQDVWTWFHSAAFDFSVWEIWGALGTGGRLVVVPYWTCRSPEDFRALLLDERVTVLNQTPSAFSRLLPLERAAPTPLALRLVVFGGEPLDARALLPWFDTHPESACRMVNMFGITETTVHVTAQTVTRADALASSQSVGRALPGWSVRVLDTRGRLVQPGCVGEIAVGGDGLALEYLGRPELTAERFVPDPDGEGRLYLSGDKGRQLPDGRLEHLGRLDSQVKLRGHRIELDEIRSVLLTHPSVRAAAVVLTRPTDANGEDATLDAYAVLDGADAREVRRHAARLLPEYMVPATVTPLAELPLTVNGKVDVAALPAPRAAGGELPCVADESAQGTLAAVLAAWHTAFGEQVAAGDDFFELGGNSLRALRVVHLLRDAGLRVDVRDVYRLRTPSALAEAASTAPADAARTA

SEQ ID NO: 30 - protein, 195 aa, Streptomyces atroolivaceus
MSKVAVLTNDLQYDLVNKNQERIDAVAEATPSFSGFLKDMRQRGHHVLHLQLINKADDPVAERYEGGRLPAQKGTQGAEILPVFLDDTDILVEKNKDSGFYETDLHERLQALGVETVIVTGMQGQICVQTTAADAFFRGYNVWVPSDCVVSAQEHDKVRALDWLDGYCATVAPSDEIVRVLDADGDLPRKVFRTP

SEQ ID NO: 31 - protein, 343 aa, Streptomyces atroolivaceus
MPTATTSFLDQKIVLDHGTGARLSRELVEFVVEVLGDVYLGEMEDSAILPPLDGALAMTTDSFVVDPPFFGNGDIGKIAVCGTVNDLAVAGAEPRYLTLAMILESGFPLSGLHRALESVRDTAREAGIKIVAGDTKVVGEGEADGIFLNTTGVGVFTSPPKRMKDVAVGDKILLSGPIGDHTIHLLSVREGLGFEKNVLSDCAPLNNMIDTVRGAVPESAVRSMRDVTRGGLNAVLHEYASALGHAVRVEEEALPISFETAMAADMLGINPINCANEGCLALFVAPEHADEVLRVLRSHPYGKDAVIVGEVTARPEPVVEMAGKDGRIQEIEELQGAELPRLC

SEQ ID NO: 32 - protein, 791 aa, Streptomyces atroolivaceus
MAETEQWLIRVTGVVQGVGYRPFVHTLATGLGLRGWVLNDTLGVQTEVSGGAGELAEFAGALKDRAPLLARVEEVRVESRTPRAGGDLPTGFEIRESRRTGRANTIVAPDSHVCDDCLREVLDPTDRRFRYPFTNCTHCGPRYSLIKGLPYDREKTTMAVFAMCEDCRAEYVNPADRRYHAQPTACPRCGPKVALSAPDGVVAEADEALTRTIRALGDGQIVAVKSVGGFHLAVNARDAAAVARLRRRKKRDSKPFAVMAAGLDETAAIAHITDAERELLRSPARPIVLLRKLPGALPEEVAPRNPNLGVMLPSAPLHQLLLDRPESDVLVMTSGNISGQPIAYRNEDALAELFEVADLILHHDRDIHVRVDDSVVRSSVHPALDEPIITFLRRSRGYAPYPVKVDDIAGPVIAYGAELKTTVALGDGNEVYVSQHIGDLKNDETYASHREAAAHLAELYELKPRHAACDLHPAFKARVLAGTDRPDDVVEVQHHHAHMASCMAENRLSGPTIGVVFDGAGYGEDGTIWGGEFLVGDFASVRRAAHLRPVPLLGGDKAVAEPVRTGYALALQALGSPERAVAAFPALEILDDRKRTVFATMAERGIQAPPVSSMGRLFDAVAALLGVCAYAEYEAHGPIELEGLLGRDLALTAPYAFGLQQEGDTELVDPRPLVRAIAADLARGTGVTDISRRFHSTVVDMVVKRCSALRERTGIRQVVLSGGVFLNEFLQVNCLVELRRAGFDAHAHRLVPTNDGGIALGQVMVANARLRASPDSTDSPATPNPGTNECR

SEQ ID NO: 33 - protein, 447 aa, Streptomyces atroolivaceus
MRTADLTLDTVVRLLSENEASARQTLSMVPSETSMSGLAKLPMLLDPYHRYFFNEGDDPDRWHFRGAQRLRDLEMELTIPLLQELGRASYASVRPLSGLNGMTLVLGALGGEPGSTVVTVSPEQGGHYATPQVAGRLGLHAEFLRGPDPHSLDLEHAAELLARVRPSLVYVDQSHCLFPVDVKSLVETVREASPGTLVHVDASHWLGLVLGDAFPNPLDQGADSWGGSTHKTFPGPQKAVVLTRDPQVEQLIRDAQDFLISNHHFAATIALGISLLEFREFGPAYTRAVLEHTGRFGRLLTERGLTVVAADRGYSAGHQLWLDTEADGIAPKDAAARLSAASLKVNFMAGLPGFTGQGVRIGLNEATYQGLSGDDIDELADIFVAAVRDTEPAALLAERTAALRTRTPFGACAADGSPLLATALDLCEGALRRTGAAAGRPLTEASR

SEQ ID NO: 34 - protein, 238 aa, Streptomyces atroolivaceus
MSRPVIGIASYRDRARWNIWDTDATVLQQGYVDGVRRAGGRAVVLPPDDTDADVVARLDGLLLPGGADVDPARYGAARHPRTDTPSADRDAGELLLLEAALAAGLPVLGVCRGLQLLALAYGGTLHQHLPDLVGHSGHCPAEGVFGRHPVHLVPGSRAAALYGELAEVNSHHHQAVLDPGGLHVTGRGEDGVVEAAEDPSRPFVLGVQWHPEVSDDRKLFAAFVAACTTRSLHTAASV

SEQ ID NO: 35 - protein, 1745 aa, Streptomyces atroolivaceus
MHTHVRPVGGTLVDILRDRADATPHRTALEFIRDDGSEHAVGYAALDRRVRAVAAALTERGLRGERVLLLFPPGENYVTAFLGCLYAGAVAVPVYVPTGKRGLSAVLATGADAGAVLALSSREVTDAITASYPELTTSGLIQWLVTEDIADAAADDWPGTGPAPADLAFLQYTSGSTGTPKGVMVRHDNLVHNSASISTALGVGPDSRGVSWLPPYHDMGLIGGILQPLYAGFPCTLISPMAFVRSPYRWLDAISRHRATVSAAPDFAYGECVRRIPEDKRAELDLSSWQHAMVGAEPVRPATLDAFARAFADSGFDRSAFHPCYGLAEATLFVTGGAPERGEPRVLRADRRELELGQAVSAIAGKENKENAAVLTGCGRSRSEDVVVVVDPAEGRACPPGGTGEVWVSGPTVTAGYWGRPELTDEVFRATLESHPGRHFLRTGDLGFALGDELFVTGRAKDLLVVRGRNHYPQDIEQSAEHAHPLLQPTRAAVFSHDDGTEERAVLVHEVVRGFDPERAPEVITAVRKAVTAEHGLSLHEVVLVRPGAIPRTTSGKVRRSTCRERWLDGTLQPIATGGADTAPDAGGGDMPPVSRAVAEVVALELDVPAEQLPPGVPLVVLDLDSLRAVRLAEAMRERFGLRVSPAELLDGLTLAGLSALVDAVDDVAEAHVGADDTEAADAPASRAQEWMWLLDAMGGGAAYHVAGGIDLHGPVDPELLRASLEDLVARHPALHSGFTSDPDGTLRRTPLAPRSFELPVVEPSADRDARAVAAELAREPFDLAAGPLLRAVLVRAGEHEWTLAVAAHHIAVDGWSLGLLLRELGICYRDRLAGRSPSRTVVTVPAPKSAGDDAEAAAFWQETLAGAQAVSLPLDPAPHPSPFKGSALPFTLPAPVVARLKRYGAKRRSTLFMVILTGLSAVLSRWTGQQDLVVGAVTAGRHRPGSGDLVGLFVNTLPLRVEASGDPAFGELLSRVRSSCLAAYRHQDLPLEEIVRLTGADRADGRAPLVRVALALQNLPVAPWQSGEVRAEPFELPSPGAQFELSLHLTEESDGSLTGHAVHASDLISAPSARRILQALTLALEAVPGPPGAAATDLPMLAPHELDRVVSEFSGSDTPLDDGLVHAGFERQARLTPNAPAVVWDGGTLSYAQLDARANRLARRLRSLGAAPDQVVAVHLPRSPELVVALLAVVKAGGAYLPLDPDHPRARLALQLADVTPSLLVTSRDAAHGRAGELAAGSPGLTLVEIDDPALAELPDGPLDEVARPDNLLYVLHTSGTTGTPKGVMNRHAGVANRMAWMQEKYPLVAGERVLHKTPVGFDVSGWEIWWPLGHGATIVLARPGGHQDPGYLVRSVVDHAVTTCHFVPSMLRVFLDETTAATAGGTLRRVVCSGEALPPDVAARFHRLLPGVELHNLYGPTEAAIDVTAEQVEPGATDRPRLPIGRPVPGVRLYVLDGRGNPAPVGVPGELHIGGPQVARGYFGRPSLTAAAFVPDPFGSGGRLYRTGDRACWTEDGTLDYLGRIDHQVKIRGQRVEPGESEAVLARHPAVGDAVVVPRRQGGETYLAAYLVAVAGAEQPGPAHLREHLSLSLPPAMIPSAYTWLDALPVGANGKLDRDALPEPDQNLAGGEHVAPRDAAEQRVAEVWCEVLGLEEVSVTADFFALGGHSLQATRIALRLREAFGAEFSVADLLTGVPTVEQTARLLTQRQVAESDPEELARLLDQLSGLSDDEVADLLQQQG

SEQ ID NO: 36 - protein, 462 aa, Streptomyces atroolivaceus
MAVTLKDDFAERARLEARLLARRRGGAALPLLDRPAGAEWHFAASLGQEGMWPSLATTARQPLIVGGLRVSGPLDTGALREAWQALAERHETLRSAYRRVDGALTQVVPVRARPVMDVALADPAAAASVADDELARPFDFGRGPLARLRVLRRASGEHLVVVCLHHLVGDARALEVVTTELTALYAGAVTGSPVQLPELPAQYADFAAWHRSRVEGEHGGRTVAYWLDRLAGAEPAALPCDRSQDPSDIAGHTRSFPLPPELFARLREVAARHRTTFYVVGLAAFQILLARWSGERDICVRAPVSYRDRSEVHGLVGDFSNDVVVRADLSGHVTLAEAVEQVRASTADDFAHHDVPPHVVASRMADPTLLERLFHVQFTAEREHDLGAARQLGPIRAEPFSPTAESVARPLSVRLRHDDHGGRVIVAYRSGLFSDERVRALQRDYFALFEEIAAHPGQPAVS

SEQ ID NO: 37 - protein, 399 aa, Streptomyces atroolivaceus
MSATRRVHIYPFEGEVDGLEIHPKFAELRETDPLARVRLPYGGEGWMVTRYDDVRAANSDPRFSRAQIGEDTPRTTPLARRSDTILSLDPPEHTRLRRLLSKAFTARRMGAMQSWLEELFAGLLDGVERTGHPADIVRDLAQPFTIAVICRLLGVPYEDRGRFQHWSEVIMSTTAYSKEEAVSADASIRAYLADLVSARRAAPHDDLLGVLVSARDDDDRLTEDELITFGVTLLVAGHETSAHQLGNMVYALLTHEDQLSLLREQPELLPRAVEELLRFVPLGNGVGNARIALEDVELSGGTVRAGEGVVAAAVNANRDPRAFDDPDRLDITREKNPHLAFGHGAHYCLGAQLARMELRVAIGGLLERFPGLRLAVPADQVEWKTGGLFRGPQRLPIAW

SEQ ID NO: 38 - protein, 78 aa, Streptomyces atroolivaceus
MAREQNTRWRIEADHGACMGTGICAGVAPDVFQVVDGRSVPPAGEVPADENVLDAVESCPMEALRVRDAVSGEVLDLS

SEQ ID NO: 39 - protein, 115 aa, Streptomyces atroolivaceus
MKFAIVIIENAESRRQIQEDRATYRKAIEGWMGQQAQAGALVGGEAFETESLAPVTVRREADGTRKAVEGPFAGADETLGGYILVEAADRDAAVEIAKSWPNPETLEVRPLWVAE

SEQ ID NO: 40 - protein, 438 aa, Streptomyces atroolivaceus
MTDGAIHTHAAGDGAGRLRPLLDAVHDTACEVRARRPDYFEHRPLRLPAELLAHHGTTPAALAQLIGDSYELTVEPVTDPADCTSVDRLAAARAQHAGTTPGDSGAQRAPQPGELAAVAREQSELRRAAERDAARIGAAAPLRVGVLGGVLPYTAAGVREEGEPPVVLVNALGMGTALWHPLMAALAPTRRVLTWAPRGTAAGTRPMRLRDQADDLAAVLATEGARDCHLVCWCSGPKTAMEFRRRRPESVRSMVFLHGSFRHTGDPAGLEPDTPYERNLEELCRAVVARPALAARLRTMFTGQPAEMSGDLTAHRFADEVLALPAPALGGELLRPFSDDAVLVAYARQLLDYWAYDGLAHAADVQVPVLCVSGEFDRIASPERLALAADRFPGARHERLAGATHHSMYDRPREVARLLTDFFTEAVRPRSIVSGAAR

SEQ ID NO: 41 - protein, 307 aa, Streptomyces atroolivaceus
MTDAASQAQGAFLPAHSGPLGSGSDLLHSGNAGFIIHRAGQLNHAFRAQGRQFATDLVGHLNKVVEGVATIVVHEEILGTADRLHWLIHMKQPNDYSRFLEIADHDRSFKEITEADRIAAAEGAGNWERMFVEGSFQERVYVPQHGLDEHDDDHDHDHHDEPSDTFVPPARHQTGLPDSRMRSSVDSGLTIIRTAQTAFRFRTEAREFAFAWASEVNRALGGELTVYLYEETFGQQDRIHWMIHLDSLDTYRKLTELSRHDADYQALFGRQFVPDFKGGGGWEQTFVSPTIQDTVLTPLHPGAPAWF

SEQ ID NO: 42 - protein, 265 aa, Streptomyces atroolivaceus
MTAIGPTHRGVRLTAEPHVLRATLTSPDGLNSLSGAALDALGAALDRAEADPECRVLLLEGSGGTFCTGLDFEEAAGDPAGGASQAGRGGAEFLALMRRFGETPLAVVACVDGRAAGGGVGLAAAADLVIATERSEFSLPEALWGLVPCCVLPVLVRRTGFQPAYAMALSTQPVSARRAADFRLVDEVVPDPDAAVRRLLVRLTRLDPATIGELKQYFRAMWFTTEDTDAFALREFTRLIDSPVARRRITDYTTTRRLPWEKPRP

SEQ ID NO: 43 - protein, 795 aa, Streptomyces atroolivaceus
MVALVFPGQGSQRKGMGADLFARFPDLTRQADTVLGHSVEELCRSSGDGRLDRTEYAQPALFVVSALSYLARDPGLPQPTLLAGHSLGEYGALFAAGCFDFATGVRLVRERGALMGRAQGGGMLAVLGVDGDEVQALLAGTGARQVDVANYNTPTQTVLSGPLDELRMVSAALGQRPGVRCVPVRVSAAFHSRHMRPAAQEFATFLTGFSFADPHRTVISSVTARPYGAGQVAELLSRQIESPVRWSETMAYLRERGTTELEEMGPGKVLTGLWKQGRADGAKARAVAPAPVAVVAGVPAAAAARAPASPAPVAARAATAAPARPSDPAPPAPRTAPSPASPVPPASVSRGQRAEELGSAEFRQDYGIRYAYLAGAMFRGIASAELVIRMGRAGLMGFFGAGGLGLDKVESALVRIKDALGPDGRYGMNLLHSIDDPAYEHAVVDLCLKHGVHDVEAAGFTQLTPAVVQFRFSGAHRDAAGRAVAVRRVLAKVSRPEVAAAFMAPAPAAILRRLTADGRLTPQEAEIAAELPVGQDICVEADSGGHTDGGAALTLLPSMIRHRDAAMARHGYGRRIRIGAAGGIGAPEAVAAAFVLGADFVLTGSVNQCSPEAGTSDAVKDILAGLDVQDTAYAPAGDMFEIGARVQVVRKGTLFAARGNKLYQLYRSHDSWESIDAGTRRSVEETYFKRPFAEVWEETRAYHLGRGRDAEIEKADRLPKHRMALAFRWYFARSVRWGLEGEPTQKVNYQIQCGPAIGAFNHVVRGTGLEDWRHRHVDLIAEHLMTGAADVLARR

SEQ ID NO: 44 - protein, 274 aa, Streptomyces atroolivaceus
MTTLTFHSTNSGVIVERTAQLKQAHRAEGRRIALEQAAYLNDKFAGQTTVTVHEETFGVRDRLHWLVHLPKLSGHREISRLLDGDEGPAADADWHGMFVDGSFSETALIPQHWGMYGTDEALPEGTVIDAAAPDLRVPPAQRQTSMSPERTLNSSGAGLMIHRVAQPKYAFRAEARLFARRITESINTRLPGIASSFLYEEAFGPADRVHWLIHMKSEDTYYDLIDMHMRMDDATRAIYLDEIIAPEKGGGTWNRLFVEESMGDIAFSPVPDAR

SEQ ID NO: 45 - protein, 4437 aa, Streptomyces atroolivaceus
MEPGTSPSGQQDASGLAARVTAVMVRVLSAARPDAQPVTAACELRGLGLDSMTAARLWLAVQGECAADVPLGWLTEATTVGEYAQRVADHASQAVPVQGAGAVGAQVAADPDALHEPFPLTPLQEAYLIGKEPELQADAVGCHLYREFDVPALDTERLRAAWQRLVEHHDILRATVTEDGRQQITAQAPRWDLAVHGSATRAEFTETATAVRARMSHHLFPAGHCPPFAIEVTLGPDGTGRVHFGIDAIVTDGQGLDLLTAQWEACYADPSHLLPAPTAPLSVRDCVVALDAARRTEAHRRDLDHWVRRLRELPGAPGLFTADAPERGTGLSCVRRSSRTARLTAAEWRSLRARAEELAVSPTSLVLTVFTEALARHGAHEPFSLVVTTSRRPQLPPEADHLVGPFTGTTFVEAVPPQQHTFEEAARLTHEGLWQALEHSAVCGVSAQRALRGGGPGPLPVVFTSMLDAAGRPRARGFAAAPVYAVSQTSGVWLDHQMWEQDGALHLRWDTADGCFAPGVVEAAFASLCNGLRALAVAGPVVTRPLNDLQQAYFVARAAGEPGPWRGCQVVVPYDTDERVDPVRLESAVVRLVEAYDVLRSAVTQDGVVEVRAGAPRRWTVPVVAGGCPDEVRDAMAAANFPLGRYPQFEVRVVRGDDGDTVLMSMDLTLTDARGIHLTGRELMRLYADPAAEPRPAEAARDSARDADEQARSRAHWQDRLRALPPGVPLPGPRDADGPDRRVRLAGAPLALRPLTDRCAEHGLSLDAVLLTAFTDVLARTYGTDFAVPVVRWDHGLDPQRPGEFTALSWLPCAPRELSFTARARTYQEGLERDADVSGSGLPELRRAVARSGGAGYPVVYTCALDLTDRPLPGSVRAGQWLSCTPDVFLDCITTVDAGQLQLAWDAVDGRAPQGGWSELHAEYRRSVARLADDAAAWQEPAGGDTSGADDGEVRGAELHKILHEWNDTTRAFPDDRLMHQLFEEQAAQQPRAEALRWRGGGTMTYQELNRRANRIAARLAAEDVGPETVVAVSVPRGPMMVAVVLGILKAGGVYLPMEPHLPAERAAVILEEAHAEVVVTTADREGWPVPDGYARVCADAAVEGPHPADADNCPRPVTQPHNTAYIIFTSGSTGRPKGVAVAHRPVLNLINWCRRTFGFGPGDMGLCVTSLGFDLSVFDVFGLLGTGAALYIADAEQQRDPALLLDVLIEEPVTFWNSAPTTLAQVGPLLDTVGTAGTGDLRLVFLSGDFTPLPLPDEVRAVFPRADMISLGGATEATVWSNWFRIGAIDPAWRSIPYGRPIDNSRYHVLDEALRPCPVGVEGDLYIGGECLALGYVNQPELTADRFIPDPFHEDPQERLYKTGDRALYYPDGNLSFQGRADGQVKVRGFRVELAEIEHRLRAHDGVKDAVVLAREDGCGDRTLVAYLVALPGSAPSGRELRGFAGQTLPEYMVPNFIGFLAGFPATANGKLDRAALPWPLAKAHLTPPDRSADADPVGSEAEAAVPVKESAAEQPAVAGGAGPSVSVPSRDELCAEIADLFAQALGVESVDADTDLWDQGATSFTMVRVSGSLQRSYKQRFPVSALLDNPSVSAIAGWVHAQLGGGADAESTAAAEAETATSVDAETTATTVTQTTAASDERPDSGPGPVDFFATEERERFKRQHWNRRPDEPGLPEVPLGDARFEDELHAWRASRRDFLDQPVPHRSFSRLLGLLRETTGADGTGALYPSAGDTYSVQVYLHLTPDAVEGLDAGLYYYDPSRHSLRLLRSGVLPDRGAHFYYNRPVFDRSRFGIYLFGQRHGIEPLYAEESLRYLTLESGYMSQLLMLGQAAHGVGLCPIGALNTEQLSQWLGLDEGHVFLQAFLGGAAEHPQRTAGGTVPFFTEPTDSDGNSGSGDSSTVITDAVAPVSAAAEDADAEPPAHTAEPAAVIGMAGRLPGAGDLDAFWDNLVSGRTAIGPAPASRPETAPSGARATGGFLPHIDRFDSLLFHVSPQEAPALDPQARLMLESVWQCLDDAGHTADSLRRSAGRVGVFIGSMWHDYRQQGADRWNGGDSAEVAATASDIANRVSHFFDFRGPSLAVDTSCSSSFAALHLAVESLRRGECGAAVVGAVNLLAHPYHWGLLDGLELLAADAPPAAYAAEGSGWHPGEGVGVLLLRPADAARRAKDTVHGLIEGTRIGHAGRAPRYGAPHTAALADSLARALADASVIPDEVDYVECAAAGAGIADAAELEALGSVLARCAGASPVPVGTLKPNIGHLEAASGLSQLIKVLLQIRHGRIAPTLVSGELSPLVDWDGLPVELVDTPRALTPRAADGRATVLVNAVGATGSYGHVVVRAPHAHGTGPAAQDGLAGAGAAPSASGPRTVVLSAASPEGLTAAAGRLRDHLAGAGRALCLDDVAWTLQTGRASLGHRLTLSADGLDGVRAGLTAFLDGRACPGLATAAADPALAGVPAGAQDLARAAGDWLRGHAVDFARLWSAPARRVPLPVQDFTVLAQERHWLAAPAARRPDGAAGSAPAAPESGQSAPPASPQVQDDRADRAQEHVAACFAEVSGIPAEQLHPRVPLEHYGLSSRLVARFNERLRQDVQGVSSTVLFEYPDLAGVAAHLAAHHEGPWSAAPDTQPSPPVPSPDPLPVPRTPAAALGESAAADGPEPIAVIGIAGRYPGAGDLETFWSNLAEGVDSVGPLPAERARDGWPTEQMWGGFLDGVDRFDALFFGIAPRDAQLMDPQERQFLQVVWETLEDAGCTRARIREQLGSDVGVFVGTMYNEYPFFGVERSLAGESADTGSAVAGIANRVSYFLDLHGPSLAVDTMCSSSLTALHLAVESLRRGECAAAVAGGVNLSLHPHKFRQQTRLKMSSSDHRCRSFGAGGDGFVPAEGVGAVLLKPLSAAEADGDRIHAVIRGTAVNHGGKTNGYMVPNPVAQGDLVRAALRRAGADPATIGYVEAHGTGTQLGDPVEINGLNRAFAGASVAPASRAIGSVKANIGHAEAAAGIAGLTKVVLQLRHRHLVPSLHTEELNDAVDWASSPFEVVREGRPWAPLTGADGAPLPRRAGLSAFGAGGANAHVVVEEYVPGTAPEPTEPGVPGVLEPQLIVLSAHDLGRLRALAGRLRDRLGRDDRPAPALADVAHTLQSGREPLRERVALVAYDVAGLCRALDLFASGDTGAWVHGRTPGGALPDGPKAVLDAAADRDAELLRLGRHWTGGGTVDWPGLHPVRRRLVSLPSYPFAEDRHWLPEPRTAAPAAAAATLTEPSGTTLYGRTWRALPPLAAAAAPAPSGRVLCVFSAPGEPVARALAALLGPDRVTLVRAGADAGNGVPGITGIGDEAEAAAFAQGLRADGPDAVGGLIDLTDLGGPAHGDAGSWTARLVLLRRLVRTLRGHGGRVLHVTEGLYGPAGPAPSLAGARMAGFVRMLGAEYGRVTGTVLDLDVSAVGPDAAARQILAEYTGPYGPGDVSVRGGVRHRPELVALPDAGHRSLTPAVDRAYLVTGGTRGIGARVARLLVRRGARRIALTGARPQPPRADWPLLSPGTPEAETASLVAELEAQGARVLVHSGPLSERERTDRFLREVREVLGPIGGVVHCAGRGPVGRPSFIGKELADFDPVLEPKTTGLEVLDELCAGDRPEFFVLFSSLSAVAPGLAAGVLDYAAANAFLDCYADHQVRSGRPWFRSVAWPTWSESGMGADRPDSCAPVGVGPLGDEEGLRVLERILALPAEQARIVPCPPIDGIAADPAALLGSPRDTDATASVGSTTSAGSTPMAGSTPMAGSTPAAGSAPVPTTTGATPPRPREEEHTVPNTSVTGPPWLAPLFSELLAIPEDALDPTALLGDLGVESVLLGEILLRLEELTGLSLDPATLLDHPTLELLGRHLADLGVPSAPPAPAATTAPAVAPVTPVTPTAPVAVAPVTPVAPSGKIAVIGLSCRFPGAEDAAAFARNLLGGTCSVTEVPPSRWDVGELYRPELEPGRSTSKWGGFLDGIEDFDPEWFGMSEDEARCLDPAVRLFLEGSATCLTDAGYGARELAGRDVGVFAGARMSHYGRRVGERRGLVGMGSDQNFIAARIAHHFDLHGPNLVVDSACSSSLVALQLACRSLLDGESELALAGGVDVLLDEEPYLDFSAAKALSRHGRCATFDEDADGFVPGEGCGVVLLKPLEKALRDGDRIHAVIDAVAVNNDGRTMGLTTPNPAAQAKVVRRALAAAGRRADEVGLIEAHGTGTMIGDPIELRALTEVFREETGRTGFCAIGSVKTNVGHLLSAAGMAGLIKAVLAVRDGRIAPTLFCERPNPRFDFAASPFYPSRTAHDWVPEPGRVRVAGVSAFGLGGTNAHAVVSQLDPVLAAAHRPRPALPAPNFARRRLWLEAAPPSAPGPRPSVPGRPPLGASILGLTFEEPLSEPGYAPLTPTPTGADTAAASQEGRKW

SEQ ID NO: 46 - protein, 7349 aa, Streptomyces atroolivaceus
MNVPSAPQPGHELVCHLVLEHSDFIMQNHRVHGVSVMPGVTFLDIVFRILRDRGFDTARAELRNVLFHEAIATSEGCDRDIRITVSTSTDGSRWITAESRRREGGESAADYQENFRGELVLHDVPEPGPLDVDRLRTTARRVADLDEMYARARAEEIRHGSAMRCFGRLYYGDGELLAELGLDGEAAALDEHFHLHPAKMDCATIAAFAQVPPPDQDPFIPVFIESFRAPRPLTGVAYAHMPRPETYAQSGDIMHNDCALYDADGRFLAGFTKLTCKRIRNPELITRLLDAPDVTRTAAPAPAAVSPSPVVAPASSDGGAGPDAVRAHLRELVGTLLGRAPHAIRTDAGFYDLGLDSGHMLDISRRLEEYVCAPLYPTLLFEFSDIDSLAAHLYAEFGAQVRSAPANPPATPATPGEDAGAPPASAARSTARAVAPALGCHRPVWTPLPADPGAFAADGARTVVLVGADAATAAALRDAAAPARVVRAERASAFQRLAADHYRLDPADPDQLASLTAALATDGISATAYVRCARTRDTDGAGSALPDAYLESWALAVAVTGTRPTGPVPVLFLHPRDPAAPRPHEDALGALARTVAAEAPQLRCRAVGHDATATAGDLAAVIAAESTDLSAESEVRHTGGTRLTVRHETLAVPSGNGAGVLREDGVYLVTGGGGSLAALLVDRLVTRGPVRLVLTGRSAPGPELTQRIEGWRRRGAEVTHVRGDVAHTDDVLAAVTCARETYGRIDGVFHCAGSVDDGMFFRKDPERSAAVLAAKVAGTRNLDEATADDGLAFFALFSSVSASVANPGQADYAYGNAFMEHFAEQRAARADRPGVSVAVGWPLWADGGMRVSEDVLRRSADTSGLHALPADAGLDALFGLLSGAAPRAVVTYGDQERIAELLPAPRPSAAQSGRTGSPDSPDSPDGDDIAIIGVAGRYPEAEDLEAFWRNLAEGRDCVGEVPADRWDHAAYYDPERGKEGRTYGRRGGFLDGVDRFDAASFGISRREAELMDPQERLFLTVGRQAVENAGYRPEELARTRVGVFAGVMWNHYQLCTDGSAEPVAPTALHCSVANRLSYCLDLSGPSMAVDTACSSSLTSLHLAVESIRRGECALAVAGGVNVAAHPQKYLQLAQGRFLSSDGRCRAFGADGDGYVPGEGVGAVLLKPLADALADGDHVHAVIKGSFLNHSGRTSGFTVPSPAAQATLIADALDRSGVAADSVGYIEAHGTGTALGDPIEIEGLRQAFADAGLAPGSCAIGSVKSGIGHLESAAGIAAVTKVLLQMRHRELVPSLHSEQPNPHIDFAATPFAVQRTRAPWVPRPGSTVLRAGVSAFGAGGSNAHVLLESAPPAPATPVAGPQLFVFSAKDERTLREVVRRQLRHLDGPGPVGSSADEATALLTGEVAALLDVPVDAVDVRENLADLGVDRLALAELGRRVEGRLPAGVPLSGQASVTELAASAALAARPDALPLADIAHTLRVGRSPLAVRLAVVCGEPEELRRRLAAFLDGDEPGEGVFTGRADDDKEPVRLERAAELFRLGRLSELARAWADGAAVEWDDCRAGDGVRPRRVPLPAHPLDERSYWIGGWRSAQETGESREPVETAHAPTAVPAAPVDQADLPEVREERPGLDPQEVLWAVVDAVRTRLYLERDEVDHRLSFNEMGVDSVGAVEIVEQLGARFALEMDPVTLFDHPTVPRLAEHVRELHRQSPAPRPQAAPAPAQPAAPEAAALPAPAPAPAPAPAPAPASKPEPAASPDACDDIAVIGMSGRFPGAEDLDAFWENIAAGRDSFTEVPAQRWDVGPVFDADRLVPDRTYSKWAAMLPEVGRFDAAFFNHSPLEAEVMDPQQRLFLEQSWAALEHAGYAVGADDRTSCGVFVGCAPGDYSTLLTEAGRADTGHAFLGTTSSLLPARIGYFLNLDGPTMAVDTACSSSLVAVHLAADSIRRGECAMALAGGVALMVTPQLHVRASKVGMLSPRGTCVPFDASADGTVLGEGVGAVVLKRLDRAVADGDHIHGVIKATGVNGDGRTNGITAPSALSQAALIADVHRRAGVGADDIGYVEAHGTGTALGDPIEVRALTEVFRRSTDRSGYCGIGTVKANIGHTTMAAGIAGLLKTLLALRHSELPPAPAFDTPNPKTELDSSPFFVVRDRQEWEPGPGGQRIATVSSFGFSGTNAHAVLAQAPEPQARPEEPDQERLFAVSARDGAALDRLLLRLADSDLDGVTPADLAFTLGVGRAHLPVRAAVIARNVPELRRRLRLLQSGAQAPGCFRTGQGAAAGDLDEQTRAELAGRARSGSPAERVAALERLAAAYAAGQDLDWQSLSYGDRPRRVPLPTYPFGGDRHWITLPDTDRTAVPATAPATSRVDLPGQSPQSTPHPLLGAVSGAPGDPDGARFPVPVPAAHWVLDHHRIGDRPVLPGAAGLDLAVAAARRCGLRGTVRLHGVQWLRLIDAEAAGTLRLTLTSDGEGYRFALSTGDDGTVCSRGSLTVRPDAQDAAAPAASSETLDVAEIAARCPYEVPAERFYDDFRSGGIAYGPSFRVLEKITFGDDEVLGTLRATPDSGGFALHPALLDGAQQTIAALEGGNDATLVPFSVETVEVVDATAVPAFAHVVRAGKHRYTVRLADRSGRVCVRYEGLALRAQHNPVDSMMYRPVWRPAPLPQPGNAPAGGRTVVVHTADSTTLAAALAARTGAGLVALSGAQDAAPDPYAVLEQPLETVYFVARTGDAEGPAEADRTALDLFRLVKRMLAVGRARDRIALRIVLAGAVPADPEDMTETVRPHAAGVLGLARAIESECPRWSVACVDVGADGGTVGAERAAERIVAEPGTEPLVLLRGEERLERVFEPLRPAAPRGTEPFREGGVYVIVGGAGGIGFALSRLLARIARARLVWIGRSPEGPEHRAKAEEIAALGGQVLYVQADVADEAALRRGLASVHTRFGQVDGAVHAALDLRDRTIALMDEEDFLAGLAPKVAGVTAFARVFGAEPLDFMLVFSSAVSFVEAGGQANYAAASTFEDAYVQWLDRRHDYPVSVVNWGFWGSVGAVADDRMRAAFARLGVGSVEPAEGMAVLRRIIAGRLPQTLAMKADRAALPAMGIRVAGTPEGEGPARTSPPATSAAPGPGTTTPAPSPAQVAVPDPVAAGAEGLSAEAVRSYVAGVFAEVLKYESAALDPEATFETFGVDSLVSLNIVDRFEQDLGDLPQTLLFEYMTIDQVAGYFRQEHGEQLTRVIAPAPTQDQGQGAVAASPAAEVVSGAAVQGGDEEVFARAQEAFAAVEAFSRDLLRRTFPRLDGVPRPGERITADELASRLGVVRRHRRLFDAALSILRSCGAVTGDADTLTFAEPSAAPGARVEGAEVAALYPEMSGHVTLLERTLGALGEVLAGRRNPMDVLFPKGSVALVEPIYKGQPIADHYNRLLADEVADAARRVRAQEGRPVRVLEIGAGTGASSRTVLAALAAADAGAHYCYTDISPAFLRHGEREFGPTYPQLAFHTLDISRDPVEQGIEAASYDVILGTHVLHATPDMERTLRNIRTLLRPGGLVLVNEITRFSEFLTLTFGLTTGWWMYEDAQCRLPHSPLLAPVQWRQSAAAAGLRTVRTGGLPGVPADELEQSLVVAERPVEDSGDASPDGAADEQSPESVRSYVTGVFAEVLKYRAEDLDPAVTLENFGVDSLVSLNIVDRLEQDLGDLPQTLLFEYTSIDSIAEYLSAEHGERLARVLGGAPAAAQAQPSAPVPAPVSVDVPAPIPAPIPAPVSVPVDVQEPESEPEPAAAVRTPAGDDPADPLDIAVIGVVGRYPQSPDLEAFWRNLSEGRSCITEIPSERWDWRRNFDPDKSRKHRSYSRWGGFLEDIEMFDAPLFGILPRDAADIDPQERLFLESCWELLETAGYLGTYTHEPQTGVFAGLMYGEYGLLAAATDWPEGRYATGHSAYWSMANRVSYTFDLQGPSLAVDSACSSALSAIQLACESLRRGESRMAIAGGTNLILHPAHFAALCARNMLSAADACRVFDDGADGFVPGEGAGAVLLKPLAQAEADGDTIWGVVKGAFSNAGGKVSGYTVPNPNAQARLVERTLRRSGVHPRTVSYVEAHGTGTALGDPIELGGLTKAFRAAGATGDGYCAVGSVKSNIGHLEGAAGIAAVTKVLLQLKHRALAPTIHLDRLNPKIDFAGSPFGPQRTAEPWDRPVAGVDGAERSWPRRAGISSFGAGGANVHMILEEYTGQDPRDAEDTMGAAGAEEPELFVLSALDRETLARHAGRVADFVAGPEGARVRLADLAHTSRVGRRELPERLAVTAASHAQLAARLREFAATGVAGEGVSTGTARKGGAGSGLGAQELTAALAGRRWADAVEHWTLGGRVDWRTADAGRLVRKVAFPTYPFNRSRHWITSDPHHLAPELASGGRPAEEPLSGSEPAAPEPAATRLPSPEPAGPEPVAAERPVAVPLPVPDLVQPVEDNDRDEGGPAADVTAERGATHPALALAAHHRISGARWVPGVSLLEVAREACPGADGSAGAEFPFRLGSVRWLTPVDLDAGTDRVTVGFTDDGTGTAFRITAGGPSGTTVARGTLTEGPCADDAGIDLAAVRDRSTGRPDPCEFYDAFARAGLEYGRPLRTVAELWTGTGECLARLSLSRLMRRVGPAHALHPALLDGALQAVSSLCAADESYLPVGMGEIRAHGALPADSWAYVREVTAEGGTGGRRRFDIRLTDGTGRVLQAVDGLEIAPRAGGGAPETRTRYLAPVWTPAPLPAGEQAPGTVLLCGAETPQRQELAGQLTAAGSTVVCASDGPAFARSDAGPHAAYTLRGTDPAEHTRLIEDLAGRGLLPDAVVHLADEAEADIHRQDVDSGESVLSFVLWSAVAVLGRPERPGLRVVFAHRAGAQGAEPLHIAVGATLRTLGLEHSRFSGVRVELPAGGAGTDEVVAELRAARPGAVEVSYAADGGRSEKNLEPFEPPAAGLCDFAPRAGGTYLITGGAGALGLHFAAYLAGRVPDDATIVLAGRSQPGGDAARRIAELNGDGARVLHRPADLRDAASVERLVASVSAEFGPLRGVLHSAGVTRDARAVKKTARELDEVLAPKVSGTVHLDAATADQPLDFFVLFSSMSGESGNLGQADYAYANAFLNAFAARRDGMRAAGLRSGRSLSIGWPLWADGGMTVDDATREMFARTWDMVPLSTHAGLEAFVRGLACELPALCVVESLVRREAAAPATAPRPAAGRQELPAMDVVALRELVEHEARVLASGFLLVDPSEVDVAAELLELGFDSITLTELVNKVNERFGLDLLPTVLFECPDLVSFAEYLTQHHAAELAQHYAPDSPAERTEVRDEPAVSDGTPAPAPASPVVPASPAPSVPTVTAVTTSPAPAPAPAPAARAEIAVIGIAGVFPGSADTDEFWEHLAGGVDLVRPVPKDRTAIRANPATRELRGGFLDSVDTFDARLFGISPNEAALMDPQQRLFLQTAWRVFEDAGYRPADLAGAPCGLFVGVATHDYDDLLKENGVAVQAHTATGIAHSVLANRVSYLFDLNGPSEAVDTACSSSLVAIHRALRAIQDGECELAVAGGVNVILTPGLLESFTQSGMLSPDGRCKTFDADADGYVRGEGVGAVLLKPLARAEADGDHIYAVVKGTAVNHGGRSNSLTAPNPESQARVVAAAVREAGVEPDTITYIEAHGTGTRLGDPIEIEGLKKAFTTLHEERGEAVPDTGRIAIGAVKTNIGHLETASGIAGVLKVVQSMRHRVLPASLHLRRLSPYLRLDGTPFTVNDRHRPWEPALTPDGRQVLRAGVSSFGFGGSNAHVVLEAYPARTAPAVQDFAPHTVPLSAGDPDDLRGYAARLARHLARTPEADLARVAYTLQTGRTGHRHRFAVRVRDRDELIGALEAFAAGELPDHAATGTARRDAPSVQSDEDPALLRKSWCEGADVPWHTWWPKTPGRVPLPTAPFARTRHWFPTPDAEPTAPAVPARKEATMTARSEAQPTRRGPKIRLAAPRSAGGASATAPTREPVPAPPAPAPAPATTAPQPVRADVPPPALPEAAAASTVVGLLRGELSKILGMPSEEIENDAPFGELGLDSIYRMDLVRTLNEAFGLDLKATELYNYDTIGKLTEFVAPLVGPAGAAPAAEPVMAEAPQQSSASLEDLVQDVIERELGRTADPAKSFVDNGFGSFDMLRVVASLERVFGALRKTLLFDHPTIGALAAHLAETHGPEAASRLSSPPQDRPRPGPAASQEPYTGGALVVEKKALAGQPELASAVAGLESAYGREGGLPGRDIAPLIFLGAGRTAYFNFSVRDDAMLTWSYVGPTEEMPALATEFVRYGQAHGLAANIVSLIRLEEVDGVRFTATPFGALQRLEGIKDFSLEGGRMQRLRYAVRKFEKAGTCRTEEYAVGSDPRTDQEITTLIDRWSAAKEMVNPYVSTVRDEIGRGILAARHRMFLTYLDDRMVSAVIVTKIPSEDGYLLDLEFYPEDAPLGSLDHTVVKIIERTAAEGCTVFSFGGSFGAKVCESPNAAPEAEAALTELRSRGIFTGDGNLRFKNKFRTENLPLYLCQPADAERTDVSRLILMIANPEVGGDRAPTAPTALAAPAPREAPAAPAPRQAPAPGQAPAARPKPAAAPPAAVAAQATEVPADARRRERQLADHGWNALHLASGDVEFDLITDSWAELDRPFVHARTARLHAGAAGRPVGQTLEGLDLLPFSCVVATTSGRAAEAALCRAWPQQGVVVHNSLFPTWYFNHLDHGFTPVAARRAAGADDGVFRGDLDLGHLNGLLTEHAGRIAFLCVEVSNNAQGGAALSLHNLTGIRETADRHGLQLVLDATRVLDNAALIAAHEPGQTGRDPLDVARELLSLADSVTISLSKDFGVDTGGIVATDDPTVAHHLRERIALRGPEAGRATRALAAAALDDLGWAATATGERVRRVADLRQALAAAGAPVAPGTGTHCVLLDTARLPALRGHEHPVPAFLAWLYLHTGIRAAAHLDDGPGTSSLVRLALPVGLGQRETAELTARLTALFGAPQQIPELLLAASDGPAALASYHPVEQVPDDIREAMAEGHTAENDNWAVLREHHPGVERVLLRLPAGDGGGDVEVFTAGAGPALLMMLPFNIGAGLFGPQFAALSERYRVIVVHHPGVGDTTACEELGYEGIADLCLRALRRLGVQGPVHVAGASFGGITAQTFALRHPESTASLTLIGSSYKLGNRAGEVNRLALVAKEDFDQVQSLSGSSRLDRERARFERLLLRCESMDPQTGLRYLDVFATAPDLLGRLGDIAVPTLIVQGRHDTVIPQKTAHLLHGAIPDARYHEVPDAGHFPSLSSSEEFNAVLSAFLEEHPA

SEQ ID NO: 47 - protein, 319 aa, Streptomyces atroolivaceus
MTITSSLDVRPEIKQAVTVRPGMCGPGSLFVGQLGDWTWETVSAQCDTDVFAARDASGNPTYLAFYYFRVRGGRELHPGSLTFGDRLTVTSGCYDQGTESVLTLHRIDRAGSDDAQRPLDLHEFYERPRDGSLYVENFNRWVTRSAPGSNEDLVKSSPPGFRNDGLPQLPAAYSPRAVYREARTAHTFRALDEPGFRLLPDTVEVEHPVDIVRDVNGVGLLYFASYFSMVDKAALALWRRLGRSDRAFLRRVVVDQQMCYLGNADLDSVLTLGARVRVSTETPGEELVDVVISDRDSGRVIAVSTLHTQHDAHDPKGEA

SEQ ID NO: 48 - protein, 86 aa, Streptomyces atroolivaceus
MTQAPLDVRAQTARLVVEVVTEILPGVDPQLIGGKRHLKDLGADSVDRVEIIAALLDRTRVDAPMSDFSDLPDIDSLIDFLSGAPR

SEQ ID NO: 49 - protein, 416 aa, Streptomyces atroolivaceus
MTATGAEQAYGIEALNVWCGLARLTAADLFAGRGLDPERLDNLMMSERSIGLPIEDPVTNAVNAARPLIEALSPEERARIELVVTSTESGVDYSKSLTSYVHKYLGLNRHCRLIEVKQACFGATAAVQTAVGYLASGISPGAKALVIATDVAVVDEKAEYSEPAAGHGAAAMLLSDRPRVLAMDLGAFGNYSYETLDSARPSPRFDIADVDRSLFAYLDCLKNAYADYAARVTDVDFTRDFDHLVMHTPFAGLVKAGHRKMMREQGVTGPRIDEDFARRVAPSLIYPGSVGNLCSGSVYLALASLLDSGVVTAPSRVGLFSYGSGCSSEFFSGIVDEQSAATVAEQGIGKRLEARARITFDEYLAVLEHNLECLVPVENRTVDPAEWEPLLDRVGDRPEILTFTGVKDYHRQYAWR

SEQ ID NO: 50 - protein, 267 aa, Streptomyces atroolivaceus
MYGSRTATRPAGEDGAAAGLRLFCFAHAGGGSSFFHPWRRALGPGVDVRPVVLPGRERRARETSHTRMGPLVEGLVTELAPQLDLPYVLFGHSLGSIVAYETARALLERGSRPPLALLVSGRRGPFVPDHRRPVHNLPEDEFLAEVSRLGGTPSEVLRQRDLLRHFLPPLRADHEVNETYRPVPPPGPALTCPVFAFTGDADPLADPHAVARWREVTSGDFRLRVFPGDHFYLKGAPDDLMSALRAAMGSVHQGSSVLRRQVHKVAT

SEQ ID NO: 51 - protein, 227 aa, Streptomyces atroolivaceus
MNLLDVTEPTGFDARLRDFLRDQSPHTTTTMVRRNQSAYSCGGQDRNVYFLESGRLKTVMFSRSGKECLLRIHTPGSIFGELCSLGGIREESAIAMRDSVVHRMSYEHFLSSITEAGIVDEFINHLTRRLAEQQQSITHLVTVDSEQRLGEILLDLARKLGRGDGRRPHIAERITHEELAGMVGTTRSRVGHFLKGFRDRGLVEVTRESHLIIDQSRLAAYLESRCV

SEQ ID NO: 52 - protein, 82 aa, Streptomyces atroolivaceus
MWDHKFETLLRDRLPGLDADAPLTEDLPLAAFGLDSMATVGLIVAIEEDYGTPLPDDAVTPANFITPGTVWELVSSLDGAGR

SEQ ID NO: 53 - protein, 516 aa, Streptomyces atroolivaceus
MSGAKLLHHWFLDGLARNPRGTALRINDRSWTYAEADRTARSWAAALHSGGRAPRRVGVLAAKSEESLLGFLAALYAGCTAVPLNPEYPVGRNRDIAAAAGLDALIVDPSGAAQLDEVAAAAPPLVTLAPRLGEWSGPRPGTPVLMPDPAGDRPPAQGPDSLAYILFTSGSTGRPKGVPIRHGNVSAFLAASLPRYDFGPDDVFGQVYELTFDLSMFEVWCAWSSGACLTVLNRLQALNPGRYIRAHGITVWTSTPSLVAALRTRGLLGGNSLPSVRHTVFCGEPLPEESAAYWSAAAPGTSIDNLYGPTELTIACTAYHWVPSPGSGTVPIGEPNTGLRYVLLDDGQVGADTGELCVTGPQMFDGYLDPANDTDRFLTHDGQRWYRTGDRVRRTPDGTLVHLGRDDGQVKIHGYRVELSEVEEAVRACAPGTEAVVLAVPGAAGPVLAAFVIGDDAAGRLTGTAQDLAHRLPPYMLPAHLWALADPPLNPNGKTDRLRLREEAARRLGRNLAPAS

SEQ ID NO: 54 - protein, 575 aa, Streptomyces atroolivaceus
MSAVFDARSDLAVPAPARPHGQGRADAAPEVISVTDLTVADPNGRPVLDGLNLTVRAGERVGVVGESGSGKTTLALALLGALRPGLRTAGGGVRVAGEDPLALRGRDLRRLRRHTVAYLPQDPAAALTPTMRVGALVSELAVRRTPEDAARTLRSVGLPDGRDFLRRFPHELSGGQQQRLALGRVLAAGPAALVLDEPTTGLDVLTQRLVLDEVARLAAERNLTLLFITHDLPAAARLTDRLAVLKAGRVVEEGPVDAVLGRPRAAYTRELVHAVPDIGEAAARPAAPAGGAADTAPVLRVSGLRAGHGRGRARVTTAQDVSFRIEPGECVALLGGSGTGKTTLARCVTGHHSPDGGLIELAGSAVPGPLRGRTLDQRRLVQLVAQDANGSLNPRRTVGAAIARPLRVLRGLGGEAAAAETERLLRLVGLDPQWAGRLPRTLSGGQRQRVAIARALAAQPRLLLCDEVTSSLDVRIQAEILALLDGLRSRLGLGLLLISHDLGVIARMADRVLVLDGGTVREQGPVAEVFAAPRHPWTRAVLDAVPSVRGELAGRAERTPAADESRPRETAVDGV

SEQ ID NO: 55 - protein, 287 aa, Streptomyces atroolivaceus
MTAPTPTATEALTPAGTQAPDTGPAAPRPGRRAALLLLLPVAAVVLFALIGPWLAPHDPARITAAPYDTGHLLLGSDGDGRDVWSRFLAGGRPLVLIPLLATAVTTLLGTASGVLAGYAGGRVDAVVSRLDTLLLALPPVLVLLVLMHGWGYRTLTLVTAVAVTGVPFVSRVARAATAQVVHAGYVDQAVALGDGPVAVMAREIVPNIVRPVLADAGTRLAIAITLTASAGFLGFGPDSPNWGAMISENMEGVTLAPWGVAAPALGLAVLTVSVNLALDRAIARFVP

SEQ ID NO: 56 - protein, 321 aa, Streptomyces atroolivaceus
MTSAVRLAALAVRRLGGALATLLVGSFVLFAAAEVLPGDAAAAALGGSATPADVARMHAELGLDRPVLVRYGDWIGAAFSGDLGHSLVDRRPVAEIISGPLADTLLLAGVCALLTVVLALAVGIAAGLRPGGLLDRLLSGGAVTLVSVPQFVTAGILTLVFSSWLGVLPAVSLVPFGEPLLAHPEALVLPVAALTLFSASWASRMVRAAVVDAAAAPHVEAARLAGLSPARVVLRHLLPTAAGPCAQVFGWLAGTLVGGTAVVEKVFNYPGLSRELVAAVQHHDAAVLEGIGLLMAAAVVGGLLLADLLAMAVDPRMRTAT

SEQ ID NO: 57 - protein, 513 aa, Streptomyces atroolivaceus
MSRVNGVGRRRFLQWGAAAATATAGATALSGCATSKSGDTRSVGSAGKLLRVGASDATGTTSLDPRHAGFGASYIALYHLYDQLMYLKGSRYELGLAESVEPNKDASEWIVRLHKHAVFHDGSPVRAADVAYSLRTLATPPSTRANNFVDLDLDRLKAVDAHTLKVGLKRPRGDFREAVLAVFSPVFPEGTRGKDFDKGVGSGPYRLEEHDGKNLRLAVNDKYWGGTSYFRRIELDLIADPAARLAALKSGQIDYAFGITATGAKAERGNSAIRVRRGGTANSNALSFAMNEQLAPFDNPDVRRAVRLAADREALVRQVLLGLGTKGDDVVGKGLPGYAGGDRKRDVAEARRLFARAKVHSLTLHAADTVPGFVAAARLLGQQLKEAGVELDVQKVPADTYYADLKGLARTPFQTFYYANRPAAVHLSATTTKGAFFNVTGLGEPHFKRLASAQATVDDSKREAAFAAVQRGLYSSGGDLLWGFQEQLDASAPGLSGVWSSQSIPVFTRARSA

SEQ ID NO: 58 - protein, 120 aa, Streptomyces atroolivaceus
MSTDTEIPIHPLFAEMIRCTAERDLDGLVDLYHPEAEWIRFTGPVRGREDIRELLKRYWELDLQHVDMNEFIQTDDTVMMRGTMIVRGETVVTFGVYVLREGKIWRQCGADEGGTRDWWA

SEQ ID NO: 59 - protein, 516 aa, Streptomyces atroolivaceus
MTERTFSYLTDQLRSHAALHPDRTALVIDGCPDLLYGEWDRRSEALARGLLAAGTSRGTRIGIFFGGMDWAGYAVAYLGALKAGATVLHLPLALPADELERRALQCELAGIVHGRTAPPTTSAVAWTGTLDELSAPGETPVDLVHSPADAAEIVYSSGTTGLARGVVVSHQNLATAGGPPSVMAHDEPTPMVASVNLGITASATTVSMVLNATPTTLVLAPPGDADRLCALIEHHAASTVMMTPNLAVQMTRDGALGRYDLTSVTTVATASAFLHPPLARALLAAMPRARVIGAYSASQAKPAVTIGTFDPARPMSAGRPAPGTHVLITDEHGAELPAHRVGRIWLRADGAPPRNRLDAGPEATGVPEGGWCDTGDLGHVDDEGELYLFDRETDAVPTPAGLVSSLRVESVLLEHEAVADAAVVAAGPAGVAAAIVPAAGATHDPKLLAATLAAHAKDSLAPHEIPERVLVVDELPRNDLGKVVKRLIRDRLTASAAGVTPAPTASAELDATGAPS

SEQ ID NO: 60 - protein, 243 aa, Streptomyces atroolivaceus
MADTLLELPDDFSRVLAIVAHPDDIEFGAGPAVAQWTAQGREVAYLLVTRGEAGISDLEPAQCGPVREAEQRKAAAELGVHEVDFLDHYNDGTIEYGPGLRRDLARAVRRHRPELIVTFNHHDTWASGAWNTPDHRAVGLAALDAVADAANRWIFPELLDEGLEPWRAGKVAIAGSPHATHAVAVDDDSRDRAVRSLAAHDRYLGSLSDDPPQERARFILGHLLAATAPRFGGRDGVAFQIVG

SEQ ID NO: 61 - protein, 474 aa, Streptomyces atroolivaceus
MTVRTDDGRQAAEQSPATGALVARLILVTLLMAELLIQVDQTIVNVALPFIQRDLDFTESGLPWVVNAYGLLYGGLLPLGGRIGDLFGRRRVLIIGVTVFTLASVVCGFSTDPTVMVIARAVQGMGGALTAPVVLSLIITSFEEGPSRQRAFALWGSAQAAGALFGLIVGGLLTSGPGWEFSFFVAVPIGALVVGLAATTIKESRADERPSIDVAGAVTFTAALLMTVFAFLDTQRSWTSPLRGGLLVVAAVLFAVFLAVERRQGHPFVPLQVFRLRNTSGALAIMAIFGATQMSYFFFVTLYLQEILGFSALQTGLAYLPLIATLLVFAQVCMKTVARVGLTRMLMTGLLCLGLGMGWLGLAASSGSFVGTVLGPTIISGIGLGLTMMPAGTLATTGVDPADAGAVSGLFNTAILVGGSLGLAVLTTVTQAVGGLGGTHGYTVAFLCSAGLAAAAILIAALVIRVPKQTDAAA

SEQ ID NO: 62 - protein, 400 aa, Streptomyces atroolivaceus
MSTEVETEKPAPVAYPFTGSEGLELSQSYAKLFEDGDPIRVQLPFGEPAWLVTRYDDARFVLTDRRFSRHLATQRDEPRMTPRAVPESILTMDPPDHTRLRTLVSKAFTPRRIESKRAWIGELAAGLVADMKAGGAPAELVGSYALAIPVTVICELLGVPEDDRTRLRGWCDAALSTGELTDEECVQSFMDLQKYFEDLVKERRAEPRDDLTSALIEARDAHDRLAEPELIGLCISILIGGFETTASEISSFVHVLQQRRELWTRLCADPEAIPAAVEELLRFVPFAANGISPRYALEDMTVGGVLVREGEPVIVDTSAVNRDGLVFDNADEVVIDRADNRHMVFGHGAHHCLGAHLARVELQEALKALVEGMPGLRLSGDVEWKADMIIRAPRVMHVEW

SEQ ID NO: 63 - protein, 134 aa, Streptomyces atroolivaceus
MTQMRIQATFVVDVWDGTDDEPVDGGPVTGRVELTKTYTEGDVKGSATGHMVTTQGPGGAAYVAQERVTGIMGGRTGTFVLEHRATQVPGTDPVTWAGIVPGSGTGELAGVSGEGSLGHGTLDLQVEFATDGAA

SEQ ID NO: 64 - protein, 216 aa, Streptomyces atroolivaceus
MAPGSGRARRGNEEGTRTHMRTVPSDATDATAPAGQTGPAYIAFLRAVNVPGRKVEMARLREVLTQLGFMGARTYIASGNAFFTGAGNDRARIVERVEAGLAEAFGFEVPTILRTTDELRTELAASPFVGRQPAPDERFSMVYSSGPLTDGEFPLRSAKGDWEVLGACGATAYVRWRLVNGRPVNPVPAIEKTFGVQATGRFFHTSEKILAAAGKG

SEQ ID NO: 65 - protein, 272 aa, Streptomyces atroolivaceus
MDREGNHRARRIDRPHSHPGGLRMTGTSVRLFCLPYAGASAGVYLPWCERLQPHIAVTPLELPGRGSRMREEPRRRLEPLLHDLVPTVARLCDRPFALYGHGFGAVLAYEIAARLEWDHELVAERLYVSGYPAPHLPPREEPIGHLPDEEFLARAGHHPRIHPGTFGEAGLARLQLPVLRADFALAESYEEGLDNTVHAPVTALAGQDDLTVRGADLGGWRDYTRRSFRARRLPGGHFHWHADERPLLNVFVDDLIRCNAAHNRFPVAERTF

SEQ ID NO: 66 - protein, 345 aa, Streptomyces atroolivaceus
MTGTLVRGAARTRPRLMAVHAHPDDESSKGAATLARYAAEGVEVLVVTCTGGERGSILNPGYPRPRGPVDMSVLRAREMERARRILGVRHSWLGYVDSGLPQGDEPLPATCFARVAPQAATARLVRLIRQFRPDVVTTYDEDGGYPHPDHVMAHRITVAAFTAAGDGAAHPRAGRPWQPLKLYYNHGSHPARSAALHRALRERGSTAPYAPLPNEPVRQPDITTRVPCAEYFPLRDRALRAHTSQVEPHGVWFAVPTPVQQEVWPTEDYTLARSLVRTELPESDLFAGIATAATVGRRGVGPRQIRARRPEGLRVKMPADAARAALRAASSGRSGSGSARSRTSW

SEQ ID NO: 67 - protein, 236 aa, Streptomyces atroolivaceus
MPPPPRATGIPDTDSAAPHAASGSATATTAAPAPPVRRPGGRTARNRAQVLDAVRSELVEHGYDALTVDAVADRAGVHRTTVYRRWGDVGGLLADVLNAGMGDDWEPADTGTLYGDLAALNHDVQTALSEQPSVTAALIAASFRSEQAARALRRFWDDRYTRCEVTVERAVERGDVPPDTAARPLLVAATAPLYHQLVLLRAEPDPLLPDEAARSAALAASAGIFTRSPSGRRALI

SEQ ID NO: 68 - protein, 539 aa, Streptomyces atroolivaceus
MPTQISVRSVTKSFDDRLVLDAVTCSLPAGERAGIIGENGSGKSTLLRLLAGRDQPDQGTVVVQADGGVGYLAQDEQLPSRATVQDVIDRALGDLRTMEERMRRLETSMADGDESGMAEYGDLMTVFELRGGYDADARVERALHGLGLDLLDRDRTVDGLSGGEQVRLRLAAVLAAGPEVLLLDEPTNHLDEDALSWLEDHLRTRRGTTVAVSHDRMFLERVATSLLEVDADSRGIVRYGNGYAGYLAEKAAARRRAAQAHAQWQADVAQLREAAATTARRVAPGRAMKDGNKMAYDRAAGRVQQSLASRVRQAEERLRRLLADPVPSPPEPLHFAPVLRAAGVQGPVLDAAGIGVAGRLDRTDLTIAAGERMLITGPNGAGKTTLLRVLADELAPDTGSVTRRGRIGYLPQEPGPGRPGESLLAAFARGRSGQTAEHRERLLSLGLFDAEQLTASVRGLSTGQRQRLALARLVTQPSDVLLLDEPTNHLSPALVEELEAALAGYDGALVVVSHDRRLRRRWQGAQLTLSTNAPQAVRV

SEQ ID NO: 69 - protein, 322 aa, Streptomyces atroolivaceus
MHHRPSGSETRTSARTNSQGVTHASVQRRVQAGVRRGPSVPSGPYDVTTGPDDALWFTLIHSGGIARLTPDGALDRHALDSPACGPSIITPGPDGALWFTRCQDHRIGRMTVTGHATSFAVATPDSGPYGIAAGGDGALWFTQLHTDRIGRITVDGRVTEFPLPFRGAFPSAITAGPDQALWFTLNRADAVGRMDLGGEVTVHPLPTEHAAPVGITVGTDGALWFVEIGAGQVGRVGTDGVVREFPLPDRACRPHAITADPARGVCWFTEWAADRIGSITPDGHIEEYELPDRGAEPHGLTVAPDGALYVALETGRILRMEL

SEQ ID NO: 70 - protein, 551 aa, Streptomyces atroolivaceus
MTTHPNFSGPTSITCAGLTYAWPDGTPVFEDLQVAVGPGRTGLIGLNGSGKSTLLKLIAGELTPASGTVRVTGEVGYLPQNVTLDTSLRVDVALGIAEARAALHAIEAGDASEEHFTAVGDDWDVEERAVAMLSGLGLGHIGLDRTIGEVSGGESVLLRLAALLLSRPDVLLLDEPTNNLDLRARRRLYATVEAWSGVLVLVSHDRELLERVDQIADLRGGEVTWYGGNLSAYEEALAAEQEAAQRMVRVAESDLKKQKRELADAQVKLARRKRYGQKMWDTKREPKVVMGERKRQAQVAAGKHRIMHEEKLAEAKDRLDEAVDAVRDDDEIHVDLPYTAVPPGRTVLTLRELHLAHGARVQGEFELRGPERIALVGRNGAGKTTLLRTITGELEPVEGEAVAHVPLRFLPQRLDVLDEALSVAENVARFAPQATNNRIRSRLARFLFKGARADQQAATLSGGERFRATLAALMLAEPAPQLLMLDEPTNNLDMASVRQLTSALSSYEGALIVASHDVPFLESIGITRWVLLDGELRDTTPEEVRGEAVTP

SEQ ID NO: 71 - protein, 469 aa, Streptomyces atroolivaceus
MPSQPPADFTDFKVADLSLAAFGRKEITLAEHEMPGLMSIREEYAAAQPLAGARITGSLHMTVQTAVLIETLVALGADVRWVSCNIYSTQDHAAAAIAAAGIPVFAWKGETLEEYWWCTEQALTWPGHTGPNMILDDGGDATLLVHKGVEYRKTGILPEAENEELAVVRALLDRSGLDWTAMSSEIRGVTEETTTGVHRLYEMHRDGTLLFPAINVNDAVTKSKFDNKYGCRHSLIDGINRATDVLIGGKTAVVCGYGDVGKGCAESLRGQGARVIITEIDPICALQAAMDGYQVATLDEVVDKADIFVTTTGNKDIIMASDMAKMKHQAIVGNIGHFDNEIDMAGLAQIPGIVKDEVKPQVHTWKFPDGKVLIVLSEGRLLNLGNATGHPSFVMSNSFADQTLAQIELFTKPDEYPTDVYVLPKHLDEKVARLHLDALGVKLTTLRPEQASYIGVEVDGPYKPDHYRY

SEQ ID NO: 72 - protein, 303 aa, Streptomyces atroolivaceus
MSTLRDILASGTPTFSFEFFPPRTEAGSRMLWQAIRRLEALSPTFVSVTYGAGGSSRDRTVEVTKRIAAQTTLRPVAHLTAVGHSVAELRHIIGQYADAGVRDVLVLRGDPPGDPNAPWTPHPQGFTHAHELVRLVRNLGGFSVGVAAFPERHPRSADWDSDISHFVAKCRAGADYAITQMFFDVEDYLRLRDRVAAAGCDTPIIPEIMPATDVRQIRRFAELSNARFPAALADRLEAAAGDPAEGHRIGVEYATSMAERLLAEGAPGLHYITLNRSTATLEIHENIQSIRTSRSTHALAAAR

SEQ ID NO: 73 - DNA, 18 bp, Streptomyces atroolivaceus
atggagatgtccgacacc

SEQ ID NO: 74 - DNA, 18 bp, Streptomyces atroolivaceus
ctactggccgctgcccag

SEQ ID NO: 75 - DNA, 18 bp, Streptomyces atroolivaceus
atgagcgacttttcccgc

SEQ ID NO: 76 - DNA, 18 bp, Streptomyces atroolivaceus
tcagcgggacgcaggcgg

SEQ ID NO: 77 - DNA, 18 bp, Streptomyces atroolivaceus
ttgcccaagcttcccatc

SEQ ID NO: 78 - DNA, 18 bp, Streptomyces atroolivaceus
tcagcgcaggccgaaggc

SEQ ID NO: 79 - DNA, 18 bp, Streptomyces atroolivaceus
atggcggacgaacctgcg

SEQ ID NO: 80 - DNA, 18 bp, Streptomyces atroolivaceus
tcatcgttccgtcctcct

SEQ ID NO: 81 - DNA, 18 bp, Streptomyces atroolivaceus
atgagcgcacggcaggag

SEQ ID NO: 82 - DNA, 18 bp, Streptomyces atroolivaceus
tcaccgtgcctcccggac

SEQ ID NO: 83 - DNA, 18 bp, Streptomyces atroolivaceus
gtgaccgacccgaccgcc

SEQ ID NO: 84 - DNA, 18 bp, Streptomyces atroolivaceus
tcagcgcgtcccgacgtc

SEQ ID NO: 85 - DNA, 18 bp, Streptomyces atroolivaceus
atggttgcgaacgagggt

SEQ ID NO: 86 - DNA, 18 bp, Streptomyces atroolivaceus
tcagccgaagcggcggaa

SEQ ID NO: 87 - DNA, 18 bp, Streptomyces atroolivaceus
atgggccgcgtgtcccag

SEQ ID NO: 88 - DNA, 18 bp, Streptomyces atroolivaceus
tcagtccatgcgctgctg

SEQ ID NO: 89 - DNA, 18 bp, Streptomyces atroolivaceus
gtggcatcgccacccacc

SEQ ID NO: 90 - DNA, 18 bp, Streptomyces atroolivaceus
tcacttgtcaccgccggt

SEQ ID NO: 91 - DNA, 18 bp, Streptomyces atroolivaceus
atgactgccgacaacctg

SEQ ID NO: 92 - DNA, 18 bp, Streptomyces atroolivaceus
tcagcccaggtagaggtc

SEQ ID NO: 93 - DNA, 18 bp, Streptomyces atroolivaceus
atgacactggacgacctg

SEQ ID NO: 94 - DNA, 18 bp, Streptomyces atroolivaceus
tcagtcgaggctgttggt

SEQ ID NO: 95 - DNA, 18 bp, Streptomyces atroolivaceus
ttgaccacgctcacgttc

SEQ ID NO: 96 - DNA, 18 bp, Streptomyces atroolivaceus
tcaccgcacgaacgcgtt

SEQ ID NO: 97 - DNA, 18 bp, Streptomyces atroolivaceus
atccaattcagctcgcga

SEQ ID NO: 98 - DNA, 18 bp, Streptomyces atroolivaceus
tcaggagcccgcggccac

SEQ ID NO: 99 - DNA, 18 bp, Streptomyces atroolivaceus
atgagcgatcgggacagt

SEQ ID NO: 100 - DNA, 18 bp, Streptomyces atroolivaceus
tcagctgcggcccgcctg

SEQ ID NO: 101 - DNA, 18 bp, Streptomyces atroolivaceus
atgcagacccagctctcc

SEQ ID NO: 102 - DNA, 18 bp, Streptomyces atroolivaceus
tcagcggcgctgcgcgcc

SEQ ID NO: 103 - DNA, 18 bp, Streptomyces atroolivaceus
atgaccattgaggtgcac

SEQ ID NO: 104 - DNA, 18 bp, Streptomyces atroolivaceus
tcatgcgggcacctcgcc

SEQ ID NO: 105 - DNA, 18 bp, Streptomyces atroolivaceus
atgacgctcaccgacctg

SEQ ID NO: 106 - DNA, 18 bp, Streptomyces atroolivaceus
tcatcggccggccggcag

SEQ ID NO: 107 - DNA, 18 bp, Streptomyces atroolivaceus
atgctgctgcgccccacc

SEQ ID NO: 108 - DNA, 18 bp, Streptomyces atroolivaceus
tcagccggccggggccga

SEQ ID NO: 109 - DNA, 18 bp, Streptomyces atroolivaceus
atgacgcagaccgccccc

SEQ ID NO: 110 - DNA, 18 bp, Streptomyces atroolivaceus
tcacgtccacggcgtgct

SEQ ID NO: 111 - DNA, 18 bp, Streptomyces atroolivaceus
atgagacccgacatgagt

SEQ ID NO: 112 - DNA, 18 bp, Streptomyces atroolivaceus
tcacagaccctcggggat

SEQ ID NO: 113 - DNA, 18 bp, Streptomyces atroolivaceus
atggccgacacccgtacc

SEQ ID NO: 114 - DNA, 18 bp, Streptomyces atroolivaceus
tcagagcacgtatcggcg

SEQ ID NO: 115 - DNA, 18 bp, Streptomyces atroolivaceus
gtggcgccgcgcacgccg

SEQ ID NO: 116 - DNA, 18 bp, Streptomyces atroolivaceus
tcaggtccgttccggtgc

SEQ ID NO: 117 - DNA, 18 bp, Streptomyces atroolivaceus
atgaccgagaccctgccc

SEQ ID NO: 118 - DNA, 18 bp, Streptomyces atroolivaceus
tcagccctccagcttctg

SEQ ID NO: 119 - DNA, 18 bp, Streptomyces atroolivaceus
atgcgatccgtccgcacc

SEQ ID NO: 120 - DNA, 18 bp, Streptomyces atroolivaceus
tcatcgctgtccctccgc

SEQ ID NO: 121 - DNA, 18 bp, Streptomyces atroolivaceus
atgacggccgacgattcg

SEQ ID NO: 122 - DNA, 18 bp, Streptomyces atroolivaceus
tcaggcgggcgcctgttc

SEQ ID NO: 123 - DNA, 18 bp, Streptomyces atroolivaceus
atgttgagtgcggcggtt

SEQ ID NO: 124 - DNA, 18 bp, Streptomyces atroolivaceus
tcatgacggcgtcccggc

SEQ ID NO: 125 - DNA, 18 bp, Streptomyces atroolivaceus
atgagcggacggctcacg

SEQ ID NO: 126 - DNA, 18 bp, Streptomyces atroolivaceus
tcaacgggcgctgtagcc

SEQ ID NO: 127 - DNA, 18 bp, Streptomyces atroolivaceus
gtgtcgtccaactcccct

SEQ ID NO: 128 - DNA, 18 bp, Streptomyces atroolivaceus
tcaggccgtcctcgccgc

SEQ ID NO: 129 - DNA, 18 bp, Streptomyces atroolivaceus
atgagcaaggtcgcggtc

SEQ ID NO: 130 - DNA, 18 bp, Streptomyces atroolivaceus
tcagggggtgcggaacac

SEQ ID NO: 131 - DNA, 18 bp, Streptomyces atroolivaceus
ttgccgacggccacgacg

SEQ ID NO: 132 - DNA, 17 bp, Streptomyces atroolivaceus
cagcacaggcggggaag

SEQ ID NO: 133 - DNA, 18 bp, Streptomyces atroolivaceus
atggcagagaccgagcag

SEQ ID NO: 134 - DNA, 18 bp, Streptomyces atroolivaceus
tcagcggcattcgttcgt

SEQ ID NO: 135 - DNA, 18 bp, Streptomyces atroolivaceus
atgcggaccgcagatctg

SEQ ID NO: 136 - DNA, 18 bp, Streptomyces atroolivaceus
tcaccgggacgcctctgt

SEQ ID NO: 137 - DNA, 18 bp, Streptomyces atroolivaceus
gtgagccggccggtcatc

SEQ ID NO: 138 - DNA, 18 bp, Streptomyces atroolivaceus
tcagacggatgccgctgt

SEQ ID NO: 139 - DNA, 18 bp, Streptomyces atroolivaceus
gtgcacactcacgtccgt

SEQ ID NO: 140 - DNA, 18 bp, Streptomyces atroolivaceus
tcagccttgctgctgcag

SEQ ID NO: 141 - DNA, 18 bp, Streptomyces atroolivaceus
atggccgtgacactcaag

SEQ ID NO: 142 - DNA, 18 bp, Streptomyces atroolivaceus
tcaactcaccgccggctg

SEQ ID NO: 143 - DNA, 18 bp, Streptomyces atroolivaceus
atgtcggctacgaggcgg

SEQ ID NO: 144 - DNA, 18 bp, Streptomyces atroolivaceus
tcaccatgcgatcggcag

SEQ ID NO: 145 - DNA, 18 bp, Streptomyces atroolivaceus
atggcacgggagcagaac

SEQ ID NO: 146 - DNA, 18 bp, Streptomyces atroolivaceus
tcacgacaggtcgagcac

SEQ ID NO: 147 - DNA, 18 bp, Streptomyces atroolivaceus
atgaagttcgcgatcgtc

SEQ ID NO: 148 - DNA, 18 bp, Streptomyces atroolivaceus
ttactcggccacccacag

SEQ ID NO: 149 - DNA, 18 bp, Streptomyces atroolivaceus
atgacggacggcgcgata

SEQ ID NO: 150 - DNA, 18 bp, Streptomyces atroolivaceus
tcaccgtgcggcgccgct

SEQ ID NO: 151 - DNA, 18 bp, Streptomyces atroolivaceus
atgaccgacgcggcgagc

SEQ ID NO: 152 - DNA, 18 bp, Streptomyces atroolivaceus
tcagaaccaggcgggcgc

SEQ ID NO: 153 - DNA, 18 bp, Streptomyces atroolivaceus
gtgacggccatcggcccg

SEQ ID NO: 154 - DNA, 18 bp, Streptomyces atroolivaceus
tcagggccgcggcttctc

SEQ ID NO: 155 - DNA, 18 bp, Streptomyces atroolivaceus
atggtggcactggttttc

SEQ ID NO: 156 - DNA, 18 bp, Streptomyces atroolivaceus
tcagcggcgggcgaggac

SEQ ID NO: 157 - DNA, 18 bp, Streptomyces atroolivaceus
atgaccaccctgaccttc

SEQ ID NO: 158 - DNA, 18 bp, Streptomyces atroolivaceus
ctagcgggcgtccggcac

SEQ ID NO: 159 - DNA, 18 bp, Streptomyces atroolivaceus
atgaccaccctgaccttc

SEQ ID NO: 160 - DNA, 18 bp, Streptomyces atroolivaceus
tcaccacttccgtccttc

SEQ ID NO: 161 - DNA, 18 bp, Streptomyces atroolivaceus
gtgaacgtgccctccgca

SEQ ID NO: 162 - DNA, 18 bp, Streptomyces atroolivaceus
tcatgccgggtgctcctc

SEQ ID NO: 163 - DNA, 18 bp, Streptomyces atroolivaceus
atgaccatcacctcgtcg

SEQ ID NO: 164 - DNA, 18 bp, Streptomyces atroolivaceus
tcatgcttcccccttcgg

SEQ ID NO: 165 - DNA, 18 bp, Streptomyces atroolivaceus
atgacccaggcaccactg

SEQ ID NO: 166 - DNA, 18 bp, Streptomyces atroolivaceus
tcatcgcggggctccgct

SEQ ID NO: 167 - DNA, 18 bp, Streptomyces atroolivaceus
atgaccgcgaccggtgcc

SEQ ID NO: 168 - DNA, 18 bp, Streptomyces atroolivaceus
tcagcgccacgcgtactg

SEQ ID NO: 169 - DNA, 18 bp, Streptomyces atroolivaceus
gtgtacggctctcggacg

SEQ ID NO: 170 - DNA, 18 bp, Streptomyces atroolivaceus
tcacgtggcaactttatg

SEQ ID NO: 171 - DNA, 18 bp, Streptomyces atroolivaceus
atgaacctgctggatgtc

SEQ ID NO: 172 - DNA, 18 bp, Streptomyces atroolivaceus
tcagacgcatcggctctc

SEQ ID NO: 173 - DNA, 18 bp, Streptomyces atroolivaceus
atgtgggaccacaagttc

SEQ ID NO: 174 - DNA, 18 bp, Streptomyces atroolivaceus
tcatcggccggctccgtc

SEQ ID NO: 175 - DNA, 18 bp, Streptomyces atroolivaceus
atgagcggcgccaagctg

SEQ ID NO: 176 - DNA, 18 bp, Streptomyces atroolivaceus
tcaggacgccggggcgag

SEQ ID NO: 177 - DNA, 18 bp, Streptomyces atroolivaceus
ttgagcgcagtcttcgac

SEQ ID NO: 178 - DNA, 18 bp, Streptomyces atroolivaceus
tcagaccccgtcgactgc

SEQ ID NO: 179 - DNA, 18 bp, Streptomyces atroolivaceus
atgacggccccgacgccg

SEQ ID NO: 180 - DNA, 18 bp, Streptomyces atroolivaceus
tcaaggcacgaacctcgc

SEQ ID NO: 181 - DNA, 18 bp, Streptomyces atroolivaceus
gtgacgtccgccgtccgg

SEQ ID NO: 182 - DNA, 18 bp, Streptomyces atroolivaceus
tcatgtcgccgtcctcat

SEQ ID NO: 183 - DNA, 18 bp, Streptomyces atroolivaceus
atgtcacgggtcaacggc

SEQ ID NO: 184 - DNA, 18 bp, Streptomyces atroolivaceus
tcacgcggacctggcccg

SEQ ID NO: 185 - DNA, 17 bp, Streptomyces atroolivaceus
atgagcaccgacaggag

SEQ ID NO: 186 - DNA, 18 bp, Streptomyces atroolivaceus
tcaggcccaccagtcgcg

SEQ ID NO: 187 - DNA, 18 bp, Streptomyces atroolivaceus
atgacggaacggacgttc

SEQ ID NO: 188 - DNA, 18 bp, Streptomyces atroolivaceus
tcatgacggggctcctgt

SEQ ID NO: 189 - DNA, 18 bp, Streptomyces atroolivaceus
atggccgacacactcctc

SEQ ID NO: 190 - DNA, 18 bp, Streptomyces atroolivaceus
tcaacccactatctggaa

SEQ ID NO: 191 - DNA, 18 bp, Streptomyces atroolivaceus
atgaccgtcaggaccgac

SEQ ID NO: 192 - DNA, 18 bp, Streptomyces atroolivaceus
tcaggcggcggcgtcggt

SEQ ID NO: 193 - DNA, 18 bp, Streptomyces atroolivaceus
gtgagcaccgaagtggaa

SEQ ID NO: 194 - DNA, 18 bp, Streptomyces atroolivaceus
tcaccactcgacgtgcat

SEQ ID NO: 195 - DNA, 18 bp, Streptomyces atroolivaceus
atgactcagatgcggatt

SEQ ID NO: 196 - DNA, 18 bp, Streptomyces atroolivaceus
ctaggcagccccgtcggt

SEQ ID NO: 197 - DNA, 18 bp, Streptomyces atroolivaceus
atggcgcccggctccggc

SEQ ID NO: 198 - DNA, 18 bp, Streptomyces atroolivaceus
tcagcccttcccggccgc

SEQ ID NO: 199 - DNA, 18 bp, Streptomyces atroolivaceus
gtggaccgagaggggaac

SEQ ID NO: 200 - DNA, 18 bp, Streptomyces atroolivaceus
tcagaacgtccgctcggc

SEQ ID NO: 201 - DNA, 18 bp, Streptomyces atroolivaceus
atgaccggcacgctcgtg

SEQ ID NO: 202 - DNA, 18 bp, Streptomyces atroolivaceus
tcaccaactggtcctgct

SEQ ID NO: 203 - DNA, 18 bp, Streptomyces atroolivaceus
atgccaccgcctccccga

SEQ ID NO: 204 - DNA, 18 bp, Streptomyces atroolivaceus
tcagatcagggcgcgccg

SEQ ID NO: 205 - DNA, 18 bp, Streptomyces atroolivaceus
atgcctacgcagatcagc

SEQ ID NO: 206 - DNA, 18 bp, Streptomyces atroolivaceus
tcagacccggacggcctg

SEQ ID NO: 207 - DNA, 18 bp, Streptomyces atroolivaceus
atgcaccacaggccgtcc

SEQ ID NO: 208 - DNA, 18 bp, Streptomyces atroolivaceus
ctagagctccatgcgcag

SEQ ID NO: 209 - DNA, 18 bp, Streptomyces atroolivaceus
atgaccacccacccgaac

SEQ ID NO: 210 - DNA, 18 bp, Streptomyces atroolivaceus
tcacggtgtcaccgcttc

SEQ ID NO: 211 - DNA, 18 bp, Streptomyces atroolivaceus
atgccctcgcagccgccc

SEQ ID NO: 212 - DNA, 18 bp, Streptomyces atroolivaceus
tcagtagcggtagtggtc

SEQ ID NO: 213 - DNA, 18 bp, Streptomyces atroolivaceus
ttgagcacgctgcgcgac

SEQ ID NO: 214 - DNA, 18 bp, Streptomyces atroolivaceus
tcagcgggcggctgcgag

SEQ ID NO: 215 - DNA, 24 bp, ARTIFICIAL
  DEGENERATE PCR PRIMER
  misc_feature (19)..(19): n is a, c, g, or t
  misc_feature (22)..(22): n is a, c, g, or t
gcgccacgagccgttyccnytnac

SEQ ID NO: 216 - DNA, 27 bp, ARTIFICIAL
  DEGENERATE PCR PRIMER
  misc_feature (22)..(22): n is a, c, g, or t
  misc_feature (25)..(25): n is a, c, g, or t
gcccaggttggaggtgarsacnacngg

SEQ ID NO: 217 - DNA, 26 bp, ARTIFICIAL
  DEGENERATE PCR PRIMER
  misc_feature (18)..(18): n is a, c, g, or t
  misc_feature (21)..(21): n is a, c, g, or t
gccggctccacctacccngtncarac

SEQ ID NO: 218 - DNA, 30 bp, ARTIFICIAL
  DEGENERATE PCR PRIMER
  misc_feature (22)..(22): n is a, c, g, or t
  misc_feature (25)..(25): n is a, c, g, or t
catcagcagctgggtcatgkmnccngcytc

SEQ ID NO: 219 - DNA, 26 bp, ARTIFICIAL
  DEGENERATE PCR PRIMER
gcstcccgsgacctgggcttcgactc

SEQ ID NO: 220 - DNA, 26 bp, ARTIFICIAL
  DEGENERATE PCR PRIMER
agsgasgasgagcaggcggtstcsac

SEQ ID NO: 221 - DNA, 35 bp, ARTIFICIAL
  DEGENERATE PCR PRIMER
atctacacstcsggcacsacsggcaagccsaaggg

SEQ ID NO: 222 - DNA, 26 bp, ARTIFICIAL
  DEGENERATE PCR PRIMER
  misc_feature (9)..(9): n is a, c, g, or t
  misc_feature (12)..(12): n is a, c, g, or t
  misc_feature (19)..(19): n is a, c, g, or t
awtgagksnccnccsrrgnmgaagaa

SEQ ID NO: 223 - protein, 67 aa, Streptomyces coelicolor
DGYGAAALVRLTDLASLGIDAEPDGPLPDGVLESIALPAEVALLRRLGGARPGVHWDRLLFSAKESV

SEQ ID NO: 224 - protein, 67 aa, Streptomyces coelicolor; identical to SEQ ID NO: 223

SEQ ID NO: 225 - protein, 67 aa, Streptomyces verticillus
QGFRGAAVARAADAASLGIDAEPNGPLPDGVLAMVSLPSEREWLAGLAARRPDVHWDRLLFSAKESV

SEQ ID NO: 226 - protein, 68 aa, Streptomyces gris
NGYRAAALARATDVLSLGIDAEPHAPLPSGVRELVTLPAERERIGPPAPEGTGEIHWDRVLFSAKESV

SEQ ID NO: 227 - protein, 64 aa, Streptomyces albus
KGYHAAAVARQDDVAAVGIDAEPHAPLPDLETIARPEDLTALSALPASGGIAWDRVLFSAKEAV

SEQ ID NO: 228 - protein, 67 aa, Streptomyces atroolivaceus
DGYRAAAVAGKGIVASIGIDAEPNARLPAGVLDLVTLADERDCVKQLLDDNPEACWDRLLLSAKESV

SEQ ID NO: 229 - protein, 53 aa, ARTIFICIAL
  CONSENSUS SEQUENCE
GYRAAALARDLASLGIDAEPGPLPDGVLEILPEILGGPGVHWDRLLFSAKESV

SEQ ID NO: 230 - DNA, 32 bp, ARTIFICIAL
  PCR PRIMER
cggaattccatatggtggcactggttttcccg

SEQ ID NO: 231 - DNA, 29 bp, ARTIFICIAL
  PCR PRIMER
cggccaagcttgcggcgggcgaggacgtc

SEQ ID NO: 232 - DNA, 32 bp, ARTIFICIAL
  PCR PRIMER
cggaattccatatgtgggaccacaagttcgag

SEQ ID NO: 233 - DNA, 29 bp, ARTIFICIAL
  PCR PRIMER
cgcgcaagctttcggccggctccgtcgag

SEQ ID NO: 234 - DNA, 32 bp, ARTIFICIAL
  PCR PRIMER
cggaattccatatgtcagtcaccgggccgccc

SEQ ID NO: 235 - DNA, 29 bp, ARTIFICIAL
  PCR PRIMER
cgcgcaagcttcccgaggtccgccagatg

SEQ ID NO: 236 - DNA, 32 bp, ARTIFICIAL
  PCR PRIMER
cggaattccatatggggccggacgcggtgcgc

SEQ ID NO: 237 - DNA, 29 bp, ARTIFICIAL
  PCR PRIMER
cgcgcaagcttgaactcggcgtacaggtg

SEQ ID NO: 238 - DNA, 32 bp, ARTIFICIAL
  PCR PRIMER
cggaattccatatggacccgcaggaggtgctg

SEQ ID NO: 239 - DNA, 29 bp, ARTIFICIAL
  PCR PRIMER
cgcgcaagcttgtgcagttccctgacgtg

SEQ ID NO: 240 - DNA, 32 bp, ARTIFICIAL
  PCR PRIMER
cggaattccatatgtcggccgaggccgtgcgg

SEQ ID NO: 241 - DNA, 31 bp, ARTIFICIAL
  PCR PRIMER
cgcgcaagcttgtgttcctggcggaagtacc

SEQ ID NO: 242 - DNA, 32 bp, ARTIFICIAL
  PCR PRIMER
cggaattccatatgtcgcccgagtccgtgcgg

SEQ ID NO: 243 - DNA, 30 bp, ARTIFICIAL
  PCR PRIMER
cgcgcaagcttgtgctcggcgctcaggtac

SEQ ID NO: 244 - DNA, 32 bp, ARTIFICIAL
  PCR PRIMER
cggaattccatatgctgcgggagctcgtggag

SEQ ID NO: 245 - DNA, 31 bp, ARTIFICIAL
  PCR PRIMER
cgcgcaagcttatggtgctgcgtcaggtact

SEQ ID NO: 246 - DNA, 32 bp, ARTIFICIAL
  PCR PRIMER
cggaattccatatggccgcctccaccgtcgtc

SEQ ID NO: 247 - DNA, 30 bp, ARTIFICIAL
  PCR PRIMER
cgcgcaagcttgaccagcggcgcgacgaac

SEQ ID NO: 248 - DNA, 29 bp, ARTIFICIAL
  PCR PRIMER
atgaattcatatgaacgtgccctccgcac

SEQ ID NO: 249 - DNA, 26 bp, ARTIFICIAL
  PCR PRIMER
ataagcttgccgtccggggagtcagg

SEQ ID NO: 250 - protein, 288 aa, Bacillus subtilis
MNEPLVFMFSGQGSQYYHMGKELFKENTVFRQSMLEMDAIIARRIGTSIVEEIYHPGKRVSDPFDSILFSHPAIFMIEYSLYKVLEDRGIYPDYVLGSVWENSCDKGKMLAILDKPQLLNDHPQLFGNSELISINYDSHFVISGEEDHIRKIMEDLKEKQILCQLLPKVYAFHSSLIDPAESAYAEFLRSKSFQKPSIPIVSSLTGSCLHVMDENFFWNAVRKPMMFREAIRYLESQHTCKFIDLGPSGTLAAFVKQLIPGDSADRCCSIITPFHQELKNLNTVEYFR

SEQ ID NO: 251 - protein, 327 aa, Paederus fuscipes
MKDLQNIQNTHPVVWMFSGQGSQYFQMGRQLYEQDETFHAWMKSLDDNVRDYIGQSLLDIIYDTGHERSLPFDRLTHTHPALFMVQYALAKSLLARGLPAPDFLIGASLGEFIAISLAGDTHVENILFNLIKQARLFDEYCNAGAMLLVIDHIDTFSTTPAFSKDCELAGINFDHCFVVSGPRTGILQTRKSLTKQNIACQLLPVSIAFHSSWMDEVHEIFIQQFPEQICRRLHTPVISCALPVPEQLTRFSSTYWWHVIRQPIAFHLAINTFHQSSPNAVYLDLGPAGNMAAATKYNLPSSIHYRILPTMTPFGRDLENIEIARLR

SEQ ID NO: 252 - protein, 316 aa, Pseudomonas fluorescens
MSIVFMFSGQGSQYRHMGRALYERHAGFGRHMRALDEVVRQTGGYSVLDGLYGDQPQAAALDDILVTHPAIFMVEYALAQSLIEHGVYPDHVLGSSLGEVAAAAVSGALDAEQALGFVVRQARLFHEHCPAGAMTAVLADIAVFEQLQADGIEVELAAINYPQHLVISGTVSALAAAQMQLARRNVVFQRLDVNRPFHSSHMDPLRDAFIQTSQALQLRTPRMGYVSSTLGGPVSQFAPEHLWHVVRSTLQLAPAIEYLEGLGPHEYLDAGPSGSMANFAKRCRSAHSASTDSLILSPFDTSARSFERRITSSAQR

SEQ ID NO: 253 - protein, 288 aa, Bacillus subtilis
MITYVFPGQGSQKQGMGSGLFDEFKELTDQADEILGYSIKRLCLENPYSNLNKTQFTQPALYVVNALSYLKKIRDEEVKPDFVAGHSLGEYNALFAAEAFDFETGLQLVRKRGELMSLISNGGMAAVMGLNEEQVAKALKEYHLHDVDIANVNAPYQIVISGKKDEIEKAASLFETMTEVTMVLPLNVSGAFHSRYMNKAKEEFEEFLHAFYFSPPSIPVISNVYAKPYTYEFMKQTLADQINHSVKWTDSISYLMKKGHMEFEEVGPGNVLTGLIHRIKKDAEAMPR

SEQ ID NO: 254 - protein, 314 aa, Bacillus subtilis
MITYVFPGQGSQQKGMGQGLFEQYQHTLDQADEILGYSIKKLCTEKSYLDVNHTEYTQPALYVVNALSYLKRVEETGRKPDFAAGHSLGEYNALMAAGAFDFETGLRLVKKRGELMGRITGGGMAAVIGLSKEQVTAVLEEHRLYDIDVANENTPQQIVISGPKKEIEKARAVFENTKDVKLFHPLNVSGAFHSRYMNEAKQVFKQYIDSFQFAPLAIPVISNVYAEPYHQDRLKDTLSEQMDNTVKWTDSIRFLMGRGEMEFAEIGPGTVLTGLIHRIKNEAEPLTYIPKKNPAISAHLKEQRNVQAGITAES

SEQ ID NO: 255 - protein, 300 aa, Paederus fuscipes
MGEQLFDRFPNITEAANDILGYSIKTLCLEDPQRQLRLTQYTQVALYVVNALTYRQHLQQGGGLPDFVAGHSLGEYNALESAGVFSFEDGLRLVQKRGDLMSQAPRGAMAAILGISADSVAGILAEQGLTRIDIANYNAPTQTIISGLEADIRDAQAVFESCQAMYVPLNTSGAFHSRYMQSARDEFAQFLEAFEFRDPQIPVVANVTAKPYVGTEVVRTLADQLTGSVRWLDSMRFLLDQGVTEFRELGPGDVLSKLVESIRSSAMSKPVSEFAAENSQQLVDEWNRTCPIGSRVRVKG

SEQ ID NO: 256 - protein, 314 aa, Pseudomonas fluorescens
KTVYMFPGQGSQFRGMGEGLFERFAELTACADRVLGYSIRELCENDPRNELGQTRFTQPALYVVNVLSYLAQAGDAAPPDYVLGHSLGEFCALFAAGAYDFETGLRLVKRRGELMSEATGGGMSAVLNLDLATIKQVLRQAGSTQLDFANFNAPQQTVLAGPLDALESVRTQIEDASGICVALNVSAPFHSRYMRGAQEAFAAELARVTFKPLTLPVIANVDARPYEQEAIASQLARQMTSSVQWVESIEYLLQAGITQFKEIGPGNVLTNLQAKIEKNRSPAQPVVASAVVAPLPLAARHDDGVPGLALTAEG

SEQ ID NO: 257 - protein, 312 aa, Streptomyces atroolivaceus
MVALVFPGQGSQRKGMGADLFARFPDLTRQADTVLGHSVEELCRSSGDGRLDRTEYAQPALFVVSALSYLARDPGLPQPTLLAGHSLGEYGALFAAGCFDFATGVRLVRERGALMGRAQGGGMLAVLGVDGDEVQALLAGTGARQVDVANYNTPTQTVLSGPLDELRMVSAALGQRPGVRCVPVRVSAAFHSRHMRPAAQEFATFLTGFSFADPHRTVISSVTARPYGAGQVAELLSRQIESPVRWSETMAYLRERGTTELEEMGPGKVLTGLWKQGRADGAKARAVAPAPVAVVAGVPAAAAARAPASPAP

SEQ ID NO: 258 - protein, 327 aa, Bacillus subtilis
MNNLAFLFPGQGSQFVGMGKSFWNDFVLAKRLFEEASDAISMDVKKLCFDGDMTELTRTMNAQPAILTVSVIAYQVYMQEIGIKPHFLAGHSLGEYSALVCAGVLSFQEAVKLIRQRGILMQNADPEQLGTMAAITQVYIQPLQDLCTEISTEDFPVGVACMNSDQQHVISGHRQAVEFVIKKAERMGANHTYLNVSAPFHSSMMRSASEQFQTALNQYSFRDAEWPIISNVTAIPYNNGHSVREHLQTHMTMPVRWAESMHYLLLHGVTEVIEMGPKNVLVGLLKKITNHIAAYPLGQTSDLHLLSDSAERNENIVNLRKKQLNKM

SEQ ID NO: 259 - protein, 308 aa, Amycolatopsis mediterranei
VVWVFPGQGTQWAGMGRELLAESPVFAERIAECAAALAPWIDWSLVDVLRGEGDLGRVDVLQPACFAVMVGLAAVWESVGVRPDAVVGHSQGEIAAACVSGALSLEDAAKVVALRSQAIAAELSGRGGMASVALGEDDVVSRLVDGVEVAAVNGPSSVVIAGDAHALDATLEILSGEGIRVRRVAVDYASHTRHVEDIRDTLAETLAGISAQAPAVPFYSTVTSEWVRDAGVLDGGYWYRNLRNQVRFGAAATALLEQGHTVFVEVSAHPVTVQPLSELTGDAIGTLRREDGGLRRLLASMGELFVRG

SEQ ID NO: 260 - protein, 303 aa, Streptomyces hygroscopicus
VVFVFPGQGWQWLGMGSALRTSSMVFAERMAECAAALSEFVDWDLFAVLDDPAVVARVDVVQPASWAVMVSLAAVWQAAGVRPDAVVGHSQGEIAAACVAGAVSLRDAARVVTLRSQVIARGLAGRGAMASVALPAQDVELVDGAWVAARNGPASTVVAGAPEAVDRVLAVHEARGVRVRRIAVDYASHTPHVELIRDELLGVIAGVDSRAPVVPWLSTVDGTWVEGPLDAEYWYRNLREPVGFEPAAGQLQAQGDTVFVEVSASPVLLQAMDDDVVTVATLRRDDGDATRMLTALAQAYVEG

SEQ ID NO: 261 - protein, 322 aa, Saccharopolyspora erythraea
AVFVFPGQGWQWAGMAVDLLDTSPVFAAALRECADALEPHLDFEVIPFLRAEAARREQDAALSTERVDVVQPVMFAVMVSLASMWRAHGVEPAAVIGHSQGEIAAACVAGALSLDDAARVVALRSRVIATMPGNKGMASIAAPAGEVRARIGDRVEIAAVNGPRSVVVAGDSDELDRLVASCTTECIRAKRLAVDYASHSSHVETIRDALHAELGEDFHPLPGFVPFFSTVTGRWTQPDELDAGYWYRNLRRTVRFADAVRALAEQGYRTFLEVSAHPILTAAIEEIGDGSGADLSAIHSLRRGDGSLADFGEALSRAFAAG

SEQ ID NO: 262 - protein, 319 aa, Polyangium cellulosum
LAFLFTGQGAQTPGMGRGLCAAWPAFREAFDRCVTLFDRELDRPLREVMWAEAGSAESLLLDQTAFTQPALFAVEYALTALWRSWGVEPELLVGHSIGELVAACVAGVFSLEDGVRLVAARGRLMQGLSAGGAMVSLGAPEAEVAAAVAPHAAWVSIAAVNGPEQVVIAGVEQAVQAIAAGFAARGVRTKRLHVSHAFHSPLMEPMLEEFGRVAASVTYRRPSVSLVSNLSGKVVTDELSAPGYWVRHVREAVRFADGVKALHEAGAGTFLEVGPKPTLLGLLPACLPEAEPTLLASLRAGREEAAGVLEALGRLWAAG

SEQ ID NO: 263 - protein, 310 aa, Amycolatopsis mediterranei
LAVLFTGQGSQWAGMGRELAETFPVFRDAFEAACEAVDTHLRERPLREVVFDDSALLDQTMYTQGALFAVETALFRLFESWGVRPGLLAGHSIGELAAAHVSGVLDLADAGELVAARGRLMQALPAGGAMVAVQATEDEVAPLLDGTVCVAAVNGPDSVVLSGTEAAVLAVADELAGRGRKTRRLAVSHAFHSPLMEPMLDDFRAVAERLTYRAGSLPVVSTLTGELAALDSPDYWVGQVRNAVRFSDAVTALGAQGASTFLELGPGGALAAMALGTLGGPEQSCVATLRKNGAEVPDVLTALAELHVRG

SEQ ID NO: 264 - protein, 275 aa, Streptomyces hygroscopicus
VVFVFPGQGSQRAGMGEELAAAFPVFARIHQQVWDLLDVPDLDVNETGYAQPALFALQVALFGLLESWGVRPDAVVGHSVGELAAGYVSGLWSLEDACTLVSARARLMQALPAGGVMAAVPVSEDEARAVLGEGVEIAAVNGPSSVVLSGDEAAVLQAAEGLGKWTRLPTSHAFHSARMEPMLEEFRAVAEGLTYRTPQVAMAAGDQVMTAEYWVRQVRDTVRFGEQVASFEDAVFVELGADRSLARLVDGIAMLHGDHEAQAAVGALAHLYVNG

SEQ ID NO: 265 - protein, 352 aa, Myxococcus xanthus
MSTSPVQELVVSGFGVTSAIGQGAASFTSALLEGAARFRVMERPGRQHQANGQTTAHLGAEIASLAVPEGVTPQLWRSATFSGQAALVTVHEAWNAARLQAVPGHRIGLVVGGTNVQQRDLVLMQDAYRERVPFLRAAYGSTFMDTDLVGLCTQQFAIHGMSFTVGGASASGLLAVIQAAEAVLSRKVDVCIAVGALMDVSYWECQGLRAMGAMGTDRFAREPERACRPFDRESDGFIFGEACGAVVVESAEHARRRGVTPRGILSGWAMQLDASRGPLSSIERESQVIGAALRHADLAPERVDYVNPHGSGSRQGDAIELGALKACGLTHARVNTTKSITGHGLSSAGAVG

What is claimed is:

1. A method of loading an extender molecule on an acyl carrier protein (ACP) domain LnmJ of SEQ ID NO: 46 comprising the step of contacting said ACP domain LnmJ of SEQ ID NO: 46, with the extender molecule and a recombinantly expressed, discrete acyl transferase (AT) LnmG having the amino acid sequence of SEQ ID NO: 43, whereby the extender molecule is loaded onto the ACP domain LnmJ of SEQ ID NO: 46 by the catalytic activity of the discrete AT LnmG of SEQ ID NO. 43.

2. A method according to claim 1 wherein the method is carried out in vitro.

3. A method according to claim 1 wherein the method is carried out in a host cell.

4. A method according to claim 3 wherein the host cell includes a vector comprising a nucleic acid encoding the discrete AT LmnG of SEQ ID) NO. 43.

5. A method according to claim 4 wherein the host cell includes a different vector comprising a nucleic acid encoding the ACP domain LnmJ of SEQ ID NO 46.

6. A method according to claim 3 wherein the host cell is a bacterium.

7. A method according to claim 1 wherein the extender molecule is malonyl CoA.

* * * * *

UNITED STATES PATENT AND TRADEMARK OFFICE
CERTIFICATE OF CORRECTION

PATENT NO. : 7,153,667 B2  Page 1 of 1
APPLICATION NO. : 10/314657
DATED : December 26, 2006
INVENTOR(S) : Ben Shen, Yi-Qiang Cheng and Gong-Li Tang It is certified that error appears in the above-identified patent and that said Letters Patent is hereby corrected as shown below:

Col. 1, Line 22 "The Government of the United States of America may have certain rights in this invention." should be -- The government has certain rights in this invention. --

Signed and Sealed this

Tenth Day of June, 2008

JON W. DUDAS
*Director of the United States Patent and Trademark Office*